US011136379B2

(12) United States Patent
Brandenburg et al.

(10) Patent No.: US 11,136,379 B2
(45) Date of Patent: *Oct. 5, 2021

(54) BINDING MOLECULES DIRECTED AGAINST INFLUENZA HEMAGGLUTININ AND USES THEREOF

(71) Applicant: Janssen Vaccines & Prevention B.V., Leiden (NL)

(72) Inventors: Boerries Brandenburg, Utrecht (NL); Ronald Vogels, Linschoten (NL); Joost A. Kolkman, Maarn (NL); Robert Heinz Edward Friesen, Wassenaar (NL)

(73) Assignee: JANSSEN VACCINES & PREVENTION B.V.

(*) Notice: Subject to any disclaimer, the term of this patent is extended or adjusted under 35 U.S.C. 154(b) by 0 days.

This patent is subject to a terminal disclaimer.

(21) Appl. No.: 16/946,092

(22) Filed: Jun. 5, 2020

(65) Prior Publication Data

US 2020/0299364 A1 Sep. 24, 2020

Related U.S. Application Data

(63) Continuation of application No. 16/455,151, filed on Jun. 27, 2019, now Pat. No. 10,703,804, which is a continuation of application No. 15/548,843, filed as application No. PCT/EP2016/052556 on Feb. 5, 2016, now Pat. No. 10,370,435.

(30) Foreign Application Priority Data

Feb. 5, 2015 (EP) .................................. 15153957

(51) Int. Cl.
| | |
|---|---|
| *C07K 16/08* | (2006.01) |
| *A61K 39/145* | (2006.01) |
| *C07K 16/10* | (2006.01) |
| *G01N 33/569* | (2006.01) |
| *A61K 39/00* | (2006.01) |

(52) U.S. Cl.
CPC .......... *C07K 16/1018* (2013.01); *C07K 16/08* (2013.01); *G01N 33/56983* (2013.01); *A61K 39/145* (2013.01); *A61K 2039/505* (2013.01); *A61K 2039/54* (2013.01); *A61K 2039/543* (2013.01); *A61K 2039/545* (2013.01); *C07K 2317/22* (2013.01); *C07K 2317/24* (2013.01); *C07K 2317/31* (2013.01); *C07K 2317/33* (2013.01); *C07K 2317/526* (2013.01); *C07K 2317/62* (2013.01); *C07K 2317/64* (2013.01); *C07K 2317/732* (2013.01); *C07K 2317/76* (2013.01); *G01N 2333/11* (2013.01); *G01N 2800/26* (2013.01)

(58) Field of Classification Search
None
See application file for complete search history.

(56) References Cited

U.S. PATENT DOCUMENTS

| | | | |
|---|---|---|---|
| 8,877,200 B2 | 11/2014 | Shriver | |
| 8,961,978 B2 | 2/2015 | Kwaks et al. | |
| 10,370,435 B2 | 8/2019 | Brandenburg et al. | |
| 10,703,804 B2* | 7/2020 | Brandenburg | .......... A61P 31/16 |
| 2010/0279352 A1 | 11/2010 | Ahmed | |
| 2011/0274702 A1 | 11/2011 | Lanzavecchia | |
| 2013/0302348 A1 | 11/2013 | Raguram | |

FOREIGN PATENT DOCUMENTS

| | | |
|---|---|---|
| CN | 102023212 | 4/2011 |
| CN | 102112155 | 6/2011 |
| CN | 102276719 | 12/2011 |
| CN | 103906763 | 7/2014 |
| CN | 104098692 A | 10/2014 |
| WO | 8403564 | 9/1984 |
| WO | 9309872 | 5/1993 |
| WO | 0063403 | 10/2000 |
| WO | 2007052242 | 5/2007 |
| WO | 2008028946 | 3/2008 |

(Continued)

OTHER PUBLICATIONS

Adam et al, "Adeno-Associated Virus 9-Mediated Airway Expression of Antibody Protects Old and Immunodeficient Mice Against Influenza Virus," Clinical and Vaccine Immunology, vol. 21, No. 11, pp. 1528-1533 (2014).

Brandenburg et al, "Mechanisms of Hemagglutinin Targeted Influenza Virus Neutralization," PLoS One, vol. 8, Issue 12, pp. e80034 (2013).

Corti et al, "A Neutralizing Antibody Selected from Plasma Cells That Binds to Group 1 and Group 2 Influenza A Hemagglutinins," Science, vol. 333, pp. 850-856 (2011).

Dreyfus et al, "Highly Conserved Protective Epitopes on Influenza B Viruses," Science, vol. 337, pp. 1343-1348 (2012).

Ekiert et al, "Antibody Recognition of a Highly Conserved Influenza Virus Epitope," Science, vol. 324, pp. 246-251 (2009).

(Continued)

*Primary Examiner* — Benjamin P Blumel
(74) *Attorney, Agent, or Firm* — Ice Miller LLP

(57) ABSTRACT

Multimeric binding molecules that are capable of specifically binding to hemagglutinin (HA) of at least two influenza A virus strains, said strains comprising HA of two different HA subtypes from phylogenetic group 2; or capable of specifically binding to hemagglutinin (HA) of at least one influenza A virus strain from phylogenetic group 1 and at least one influenza A virus strain from phylogenetic group 2; or capable of specifically binding to hemagglutinin (HA) of at least one influenza B virus strain are provided. The binding molecules preferably are also capable of neutralizing at least two influenza A virus strains from phylogenetic group 2; or capable of neutralizing at least one influenza A virus strain from phylogenetic group 1 and at least one influenza A virus strain from phylogenetic group 2; or capable of specifically neutralizing at least one influenza B virus strain.

17 Claims, 32 Drawing Sheets

Specification includes a Sequence Listing.

(56) References Cited

FOREIGN PATENT DOCUMENTS

| WO | 2009121004 A2 | 10/2009 |
|---|---|---|
| WO | 2009147248 A2 | 12/2009 |
| WO | 2010037046 A1 | 4/2010 |
| WO | 2013/007770 A1 | 1/2013 |
| WO | 2013011347 A1 | 1/2013 |
| WO | 2013030604 A1 | 3/2013 |
| WO | 2013132007 | 9/2013 |

OTHER PUBLICATIONS

Ekiert et al, "A Highly Conserved Neutralizing Epitope on Group 2 Influenza A Viruses," Science, vol. 333, pp. 843-850 (2011).

Ekiert et al, "Cross-Neutralization of Influenza A Viruses Mediated by a Single Antibody Loop," Nature, vol. 489, pp. 526-536 (2012).

Hessell et al, "Fc Receptor But Not Complement Binding is Important in Antibody Protection Against HIV," Nature, vol. 449, pp. 101-104 (2007).

Hufton et al, "The Breadth of Cross Sub-Type Neutralisation Activity of a Single Domain Antibody to Influenza Hemagglutinin Can Be Increased by Antibody Valency," PLoS One, vol. 9, Issue 8, pp. e103294 (2014).

Hultberg et al, "Llama-Derived Single Domain Antibodies to Build Multivalent, Superpotent and Broadened Neutralizing Anti-Viral Molecules," PLoS One, vol. 6, Issue 4, pp. e17665 (2011).

Johnson et al, "Vector-Mediated Gene Transfer Engenders Long-Lived Neutralizing Activity and Protection Against SIV Infection in Monkeys," Nature Medicine, vol. 15, No. 8, pp. 901-906 (2009).

Kashyap et al, "Protection From the 2009 H1N1 Pandemic Influenza by an Antibody From Combinatorial Survivor-Based Libraries," PLoS Pathog, vol. 6, pp. e1000990 (2010).

Klein et al, "Progress in Overcoming the Chain Association Issue in Bispecific Heterodimeric IgG Antibodies," mAbs, vol. 4, No. 6, pp. 653-663 (2012).

Krause et al, "Human Monoclonal Antibodies to Pandemic 1957 H2N2 and Pandemic 1968 H3N2 Influenza Viruses,"Journal of Virology, vol. 86, No. 11, pp. 6334-6340 (2012).

Kuo et al, "Neonatal Fc Receptor and IgG-Based Therapeutics," mAbs, vol. 3, Issue 5, pp. 422-430 (2011).

Labrijn et al, "Efficient Generation of Stable Bispecific IgG1 by Controlled Fab-arm Exchange," PNAS, vol. 110, No. 13, pp. 5145-5150 (2013).

Lee et al, "Heterosubtypic Antibody Recognition of the Influenza Virus Hemagglutinin Receptor Binding Site Enhanced by Avidity," Proc Natl Acad Scie USA, vol. 109, No. 42, pp. 17040-17045 (2012).

Limberis et al, "Intranasal Antibody Gene Transfer in Mice and Ferrets Elicits Broad Protection Against Pandemic Influenza," Sci Transl Med, vol. 5, Issue 187, pp. 1-8 (2013).

Strohl, "Optimization of Fc-Mediated Effector Functions of Monoclonal Antibodies," Current Opinion in Biotechnology, vol. 20, pp. 685-691 (2009).

Sui et al, "Structural and Functional Bases for Broad-Spectrum Neutralization of Avian and Human Influenza A Viruses," Nat Struct Mol Biol, vol. 16, No. 3, pp. 265-273 (2009).

Suscovich and Alter, "In Situ Production of Therapeutic Monoclonal Antibodies," Expert Reviews Vaccines, vol. 14, No. 2, pp. 205-219 (2015).

Tan et al, "A Pan-H1 Anti-Hemagglutinin Monoclonal Antibody With Potent Broad-Spectrum Efficacy In Vivo," Journal of Virology, vol. 86, No. 11, pp. 6179-6188 (2012).

Throsby et al, "Heterosubtypic Neutralizing Monoclonal Antibodies Cross-Protective Against H5N1 and H1N1 Recovered From Human IgM+ Memory B Cells," PLoS One, vol. 3, Issue 12, pp. e3942 (2008).

Tillib et al, Formatted Single-Domain Antibodes Can Protect Mice Against Infection With Influenza Virus (H5N2), Antiviral Research, vol. 97, No. 3, pp. 245-254 (2013).

Tsibane et al, "Influenza Human Monoclonal Antibody 1F1 Interacts With Three Major Antigenic Sites and Residues Mediating Human Receptor Specificity in H1N1 Viruses," PLoS Pathog, vol. 8, Issue 12, pp. e1003067 (2012).

Vanlandschoot et al, "Nanobodies: New Ammunition to Battle Viruses," Antiviral Research, vol. 92, No. 3, pp. 389-407 (2011).

Wang et al, "Broadly Protective Monoclonal Antibodies Against H3 Influenza Viruses Following Sequential Immunization with Different Hemagglutinins," PLoS Pathog., vol. 6, Issue 2, ppl. e1000796 (2010).

Xu et al, "Structural Basis of Preexisting Immunity to the 2009 H1N1 Pandemic Influenza Virus," Science, vol. 328, No. 5976, pp. 357-360 (2010).

Yoshida et al, "Cross-Protective Potential of a Novel Monoclonal Antibody Directed Against Antigenic Site B of the Hemagglutinin of Influenza A Viruses," PLoS Pathog., vol. 5, Issue 3, pp. e1000350 (2009).

Int'l Search Report dated Apr. 5, 2016 in Int'l Application No. PCT/EP2016/052556.

Glaven et al, "Linking Single Domain Antibodes that Recognize Different Epitopes on the Same Target," Biosensors, Col. 2, pp. 43-56 (2012).

Hagihara, Yoshihisa, "Next-Generation Antibodies: Molecular Theory of Camel Antibodies", Bio Industry, vol. 25, No. 5, pp. 15-22, (2008).

Cardoso et al., "Single-Domain Antibodies Targeting Neuraminidase Protect against an H5N1 Influenza Virus Challenge," Journal of Virology, vol. 88, Iss. 15, pp. 8278-8296 (2014).

Written Opinion dated May 4, 2016 in Int'l Application No. PCT/EP2016/052556.

Int'l Search Report dated Apr. 15, 2016 in Int'l Application No. PCT/EP2016/052363.

Written Opinion dated Apr. 15, 2016 in Int'l Application No. PCT/EP2016/052363.

J. Brown et al., "The Effect of Antineuraminidase Antibody on the Elution of Influenza Virus from Cells", Journal of General Virology, (Mar. 1, 1968), vol. 2, No. 2, doi:10.1099/0022-1317-2-2-291, ISSN 0022-1317, pp. 291-295, XP055197844.

Shoji et al., "An Influenza N1 Neuraminidase-Specific Monoclonal Antibody With Broad Neuraminidase Inhibition Activity Against H5N1 HPAI Viruses," Human Vaccines, pp. 199-204 (2011).

Kasel et al., "Effect of Influenza Anti-Neuraminidase Antibody on Virus Neutralization," Infection and Immunity, vol. 8, No. 1, pp. 130-131 (1973).

Findlay et al., "Appropriate Calibration Curve Fitting in Ligand Binding Assays," The AAPS Journal, vol. 9, No. 2, Article 29, pp. E260-E267 (2007).

Kabat et al., "Identical V Region Amino Acid Sequences and Segments of Sequences in Antibodies of Different Specificities: Relative Contributions of VH and VL Genes, Minigenes, and Complementarity-Determining Regions to Binding of Antibody-Combining Sites," The Journal of Immunology, vol. 147, No. 5, pp. 1709-1719 (1991).

Marissen et al, "Novel Rabies Virus-Neutralizing Epitope Recognized by Human Monoclonal Antibody: Fine Mapping and Escape Mutant Analysis," Journal of Virology, vol. 79, No. 8, pp. 4672-4678 (2005).

Yoko Shoji et al., "An influenza N1 neuraminidase-specific monoclonal antibody with broad neuraminidase inhibition activity against H5N1 HPAI viruses", Human Vaccines, (Jan. 1, 2011), vol. 7, No. 0, doi:10.4161/hv.7.0.14595, ISSN 1554-8600, pp. 199-204, XP055055573.

Int'l Search Report dated Jul. 11, 2016 in Int'l Application No. PCT/EP2016/060438.

Written Opinion dated Jul. 11, 2016 in Int'l Application No. PCT/EP2016/060438.

Hoffmann Julia et al, "A new class of synthetic anti-lipopolysaccharide peptides inhibits influenza A virus replication by blocking cellular attachment", Antiviral Research, (Jan. 30, 2014), vol. 104, doi:10.1016/J.ANTIVIRAL.2014.01.015, ISSN 0166-3542, pp. 23-33, XP028624666.

Mohamed Rajik et al, "A novel peptide inhibits the influenza virus replication by preventing the viral attachment to the host cells",

(56) References Cited

OTHER PUBLICATIONS

International Journal of Biological Sciences, Ivyspring International Publisher, Australia, (Aug. 8, 2009), vol. 5, No. 6, ISSN 1449-2288, pp. 543-548, XP008140577.
Doyle Tracey M et al, "Universal anti-neuraminidase antibody inhibiting all influenza A subtypes", Antiviral Research, (Sep. 30, 2013), vol. 100, No. 2, doi:10.1016/J.ANTIVIRAL.2013.09.018, ISSN 0166-3542, pp. 567-574, XP028763318.
Doyle Tracey M et al, "A monoclonal antibody targeting a highly conserved epitope in influenza B neuraminidase provides protection against drug resistant strains", Biochemical and Biophysical Research Communications, (Oct. 16, 2013), vol. 441, No. 1, doi:10.1016/J.BBRC.2013.10.041, ISSN 0006-291X, pp. 226-229, XP028766146.
Gravel C et al, "Qualitative and quantitative analyses of virtually all subtypes of influenza A and B viral neuraminidases using antibodies targeting the universally conserved sequences", Vaccine, Elsevier Ltd, GB, vol. 28, No. 36, ISSN 0264-410X, (Aug. 16, 2010), pp. 5774-5784, (Jul. 9, 2010), XP027204848.
Hashem et al., "A broadly protective anti-influenza neuraminidase monoclonal antibody (VAC11P.1100)," Journal of Immunology, vol. 194, No. 1, Abstract (May 2015).
Kanegae et al, "Evolutionary Pattern of the Hemagglutinin Gene of Influenza B Viruses Isolated in Japan: Cocirculating Lineages in the Same Epidemic Season," Journal of Virology, vol. 64, No. 6, pp. 2860-2865 (Jun. 1990).
Krystal et al, "Evolution of influenza A and B viruses: Conservation of structural features in the hemagglutinin genes," Proceedings of the National Academy of Sciences of the United States of America, vol. 79, pp. 4800-4804 (Aug. 1982).
Kubota-Koketsu R et al, "Broad neutralizing human monoclonal antibodies against influenza virus from vaccinated healthy donors", Biochemical and Biophysical Research Communications, Academic Press Inc. Orlando, FL, US, vol. 387, No. 1, doi:10.1016/J.BBRC.2009.06.151, ISSN 0006-291X, (Sep. 11, 2009), pp. 180-185, (Jul. 4, 2009), XP026378974.
Rota et al., "Cocirculation of Two Distinct Evolutionary Lineages of Influenza Type B Virus Since 1983," Virology, vol. 175, pp. 59-68 (1990).
Thompson et al., "Mortality Associated with Influenza and Respiratory Syncytial Virus in the United States," JAMA, vol. 289, No. 2, pp. 179-186 (Jan. 2003).
Thompson et al, "Influenza-Associated Hospitalizations in the United States," JAMA, vol. 292, No. 11, pp. 1333-1340 (Sep. 2004).
Teddy John Wohlbold et al, "Vaccination with Adjuvanted Recombinant Neuraminidase Induces Broad Heterologous, but Not Heterosubtypic, Cross-Protection against Influenza Virus Infection in Mice", MBIO, (Mar. 10, 2015), vol. 6, No. 2, doi:10.1128/mBio.02556-14, pp. e02556-14, XP055293875.
World Health Organization, "WHO Manual on Animal Influenza Diagnosis and Surveillance," Edition May 2002 (2005).
Wrammert Jens et al, "Rapid cloning of high-affinity human monoclonal antibodies against influenza virus", Nature, Nature Publishing Group, United Kingdom, (May 29, 2008), vol. 453, No. 7195, doi:10.1038/NATURE06890, ISSN 0028-0836, pp. 667-671, XP002524388.
Int'l Search Report and Written Opinion dated May 2, 2017 in Int'l Application No. PCT/EP2017/054561.
Tiller et al. Annu Rev. Biomed. Eng. Author manuscript in PMC Feb. 2, 2017, p. 1-29.

* cited by examiner

BINDING MOLECULES DIRECTED AGAINST INFLUENZA HEMAGGLUTININ AND USES THEREOF

CROSS REFERENCE TO RELATED APPLICATIONS

This application is continuation of U.S. application Ser. No. 16/455,151, filed Jun. 27, 2019, which is a continuation of U.S. application Ser. No. 15/548,843, filed Aug. 4, 2017, now U.S. Pat. No. 10,370,435, issued Aug. 6, 2019, which is a Section 371 of International Application No. PCT/EP2016/052556, filed Feb. 5, 2016, which was published in the English language on Aug. 11, 2016 under International Publication No. WO 2016/124768 A1, claiming priority under 35 U.S.C. § 119(b) to European Patent Application EP 15153957.4, filed Feb. 2, 2015. Each disclosure is incorporated herein by reference in its entirety.

REFERENCE TO SEQUENCE LISTING SUBMITTED ELECTRONICALLY

This application contains a sequence listing, which is submitted electronically via EFS-Web as an ASCII formatted sequence listing with a file name "Sequence Listing_004852_50US3", creation date of May 19, 2020, and having a size of 723 KB. The sequence listing submitted via EFS-Web is part of the specification and is herein incorporated by reference in its entirety.

FIELD OF THE INVENTION

The present invention relates to the field of medicine. The invention provides binding molecules, in particular single domain antibodies and multi-domain antibodies binding to influenza hemagglutinin of influenza A and/or B viruses. Preferably, the binding molecules are also capable of neutralizing influenza A and/or B viruses. The invention further provides nucleic acid molecules encoding the single domain antibodies and multi-domain antibodies, as well as compositions comprising the same. The invention further relates to the diagnosis, prophylaxis and/or treatment of an infection caused by influenza A and/or influenza B viruses.

INTRODUCTION

Seasonal influenza A is a major public health problem, killing more than 250,000 worldwide each year, while creating an economic burden for millions. Pandemic influenza, which occurs when a new virus emerges and infects people globally that have little or no immunity, represents even a greater threat to human health; for example, the 1918 "Spanish Flu" pandemic caused an estimated 50 million deaths. Of continuing concern is highly pathogenic avian influenza (HPAI) which has demonstrated mortality rates of greater than 50% in infected humans. H5 as well as H7 influenza viruses are endemic in poultry in certain parts of the world. These viruses currently do not appear to be able to transmit readily from person to person, but recent data for avian H5 indicate that only a few amino acid changes are sufficient to enable this virus to spread through aerosol transmission in a mammalian in vivo model system.

To date, less attention has been paid to influenza B viruses. This may be due to the fact that—primarily being restricted to humans as host—influenza B viruses lack the large animal reservoirs that are key to the emergence of pandemic influenza A strains. However, the cumulative impact of annual epidemics exceeds that of pandemics and although the morbidity and mortality rates attributable to influenza B are lower than those of e.g. H3N2 viruses, they are generally higher than those of H1N1 viruses.

Although vaccines are the mainstay of influenza virus infection control, their timely implementation presents several technical challenges. These include (i) prediction of which viral strains will emerge and infect the human population, (ii) the lag period between the appearance of a new viral strain and the availability of a clinically approved vaccine, (iii) poor immunogenicity in certain patient groups, for example the elderly, very young or immune-compromised, and (iv) limited worldwide production capacity.

Anti-viral drugs such as the neuraminidase inhibitors oseltamivir and zanamivir and the M2 inhibitors amantadine and rimantadine are an important addition to the arsenal of treatment options against both seasonal and pandemic influenza. However, these drugs have limited efficacy if administered late in infection and widespread use is likely to result in the emergence of resistant viral strains. Furthermore the use of oseltamivir in adults is associated with adverse effects, such as nausea, vomiting, psychiatric effects and renal events.

Antibodies represent one of the earliest classes of protective agents and the passive transfer of serum from convalescent patients was used successfully during previous influenza pandemics. However, this approach has limited potential for implementation on a global scale due to (i) restricted supply of appropriate sera, (ii) high risk of toxicity, (iii) high lot-to-lot variation, (iv) uncertain dosing and (v) difficulties in administration.

Advances in recombinant monoclonal antibody technology have made this strategy worthy of further investigation, not in the least because unlimited quantities of protective antibodies can be produced and stock-piled to provide immediate protection in a pandemic emergency. For this to be an effective strategy such antibodies would be required to have neutralizing activity across different viral subtypes. This presents a major challenge as the viral coat proteins, in particular hemagglutinin (HA), of influenza viruses are constantly changing.

Hemagglutinin or HA is a trimeric glycoprotein that is anchored to the influenza viral coat and has a dual function: it is responsible for binding to the host cell surface receptor sialic acid and, after uptake, it mediates the fusion of the viral and endosomal membrane leading to release of the viral RNA in the cytosol of the cell. HA comprises a large and variable head domain and a smaller more-conserved stem domain. Most neutralizing antibodies against HA recognize epitopes in the hypervariable regions in the head region and thus interfere with binding to host cells. Recently, however new monoclonal antibodies have been identified that bind to the HA stem region and interfere with membrane fusion (Corti et al., 2011; Dreyfus et al., 2012; Ekiert et al., 2009, Ekiert et al., 2011 and Ekiert et al., 2012; Kashyap et al., 2010; Krause et al., 2012; Lee et al., 2012; Sui et al., 2009; Tan et al., 2012; Throsby et al., 2008; Tsibane et al., 2012; Wang et al., 2010; Yoshida et al., 2009).

At least some of these broadly neutralizing antibodies have shown an unprecedented breadth of cross-reactivity, enabling them to neutralize many different strains within a subtype, phylogenetic group or even between different groups and subtypes of influenza virus. The therapeutic and prophylactic potential of these antibodies has been demonstrated in both mouse and ferret models, and several are now being evaluated in human clinical trials. However, these monoclonal antibodies may also have some inherent limitations which present a major challenge to their broad application in influenza prevention and/or treatment. These limitations may include (i) requirement of parenteral administration; (ii) high cost of goods; (iii) incomplete coverage of circulating influenza strains; (iv) low bioavailability at the site of infection; and (v) risk of emerging drug resistance.

Single domain antibodies (sdAbs) are antibody fragments consisting of a single antigen-binding variable domain. These fragments have several advantages over conventional monoclonal antibodies including; (i) small size (15 kDa), (ii) low cost microbiological production, (iii) simple engineering into multi-specific formats, (iv) high stability with the potential to support non-injectable routes of administration, and/or (iv) potential to access buried or hidden epitopes. These favorable properties make sdAbs an attractive alternative to monoclonal antibodies, especially in the area of infectious disease. Neutralizing sdAbs against several different viruses have been described in literature including HIV, Hepatitis B virus, Respiratory Syncytial virus, Rabies virus, FMDV, Poliovirus and Rotavirus (Vanlandschoot et al., 2011).

HA binding sdAbs that are capable of neutralizing influenza have also been described in literature. Thus, Hultberg et al. (2011) identified an sdAb (Infl-C8) with neutralizing activity against multiple H5N1 viruses. Infl-C8 dimers and trimers showed improved and broadened activity against H5N1 viruses. However, no cross-neutralization of PR8 (H1N1) or X47 (H3N2) influenza viruses was observed.

WO2009/147248 discloses several sdAbs showing heterosubtypic binding activity in ELISA. However, none of these sdAbs, except one, was active in a virus neutralization assay. This one neutralizing sdAb, called IV146, showed phylogenetic group 1 restricted binding in ELISA and was capable of neutralizing 2 different H5 viruses.

Tillib et al. (2013) describe multiple sdAbs with in vitro and in vivo neutralizing activity against the H5N2 strain A/Mallard duck/Pennsylvania/10218/84.

Hufton et al. (2014) identified several sdAbs with cross-subtype neutralizing activity against H1, H2, H5 and/or H9 viruses. None of these sdAbs however was able to neutralize H7N2. Dimerization of one of the sdAbs improved its activity towards H1, H2, H5 and H9 but did not result in cross-group neutralization of H7N2 or H3N2 viruses.

None of the monomeric or multimeric sdAbs identified to date thus are able to neutralize all relevant seasonal (H1N1, H3N2 and B) and pandemic (e.g. H5N1 and H7N9) influenza strains. In view of the severity of respiratory illness caused by influenza A and influenza B viruses, as well has the high economic impact of the seasonal epidemics, and the continuing risk for pandemics, there is an ongoing need for new effective inhibitors with broad activity against influenza A and B viruses and which can be used as medicaments for prevention or treatment of influenza infection.

SUMMARY OF THE INVENTION

The present invention provides novel single domain antibodies (sdAbs) capable of specifically binding to hemagglutinin (HA) of at least two influenza A virus strains, said at least two influenza virus strains comprising HA of two different subtypes from phylogenetic group 2; or capable of specifically binding to at least one influenza A strain from phylogenetic group 1 and at least one influenza A virus strain from phylogenetic group 2; or capable of specifically binding to hemagglutinin (HA) of at least one influenza B virus strain. In certain embodiments, the sdAbs are also capable of neutralizing at least two different influenza A virus strains comprising two HA different subtypes from phylogenetic group 2; or at least one influenza A virus strain from phylogenetic group 1 and at least one influenza A virus strain from phylogenetic group; or at least one influenza B virus strain.

The present invention further provides so-called multi-domain antibodies, i.e. binding molecules comprising at least two, preferably at least three, more preferably at least four, or even more preferably at least five, single domain antibodies as described herein. In certain embodiments, the multi-domain antibodies are capable of neutralizing at least one influenza A virus strain from phylogenetic group 1 and at least one influenza A virus strain from phylogenetic group 2. In certain embodiments, the multi-domain antibodies are capable of neutralizing at least one influenza A virus strain from phylogenetic group 1 and at least one influenza A virus strain from phylogenetic group 2 and at least one influenza B virus strain, preferably at least one influenza B virus strain from the B/Yamagata lineage and at least one influenza virus strain from the B/Victoria lineage. In certain embodiments, the multi-domain antibodies are capable of neutralizing influenza viruses comprising HA of the H1 subtype (such as H1N1 influenza virus strains), influenza viruses comprising HA of the H3 subtype (such as H3N2 influenza virus strains), influenza viruses comprising HA of the H5 subtype (such as H5N1 influenza virus strains), and influenza viruses comprising HA of the H7 subtype (such as H7N9 influenza virus strains), and at least one influenza B virus, preferably at least one influenza B virus strain from the B/Yamagata lineage and at least one influenza virus strain from the B/Victoria lineage.

The invention furthermore provides nucleic acid molecules encoding the sdAbs or multi-domain antibodies, as well as vectors and host cells comprising said nucleic acid molecules.

The invention also provides (pharmaceutical) compositions comprising one or more sdAbs, multi-domain antibodies, nucleic acid molecules and/or vectors as described herein.

According to the present invention, novel influenza hemagglutinin-binding molecules are provided. The binding molecules may be single domain antibodies or multi-domain antibodies. At least some of binding molecules of the present invention are unique in that they are cross-neutralizing between phylogenetic groups, i.e. able to bind to and neutralize at least one influenza A virus strain from phylogenetic group 1 and at least one influenza A virus strain from phylogenetic group 2. In certain embodiment the binding molecules are capable of specifically binding to and neutralizing at least one influenza B virus strain, preferably at least one influenza B virus strain from the B/Yamagata lineage and at least one influenza virus strain from the B/Victoria lineage. The binding molecules and nucleic acid sequences of the present invention are suitable for use as a diagnostic, prophylactic, and/or treatment agents for influenza infections, even irrespective of the causative influenza subtype.

DEFINITIONS

Figure 1:
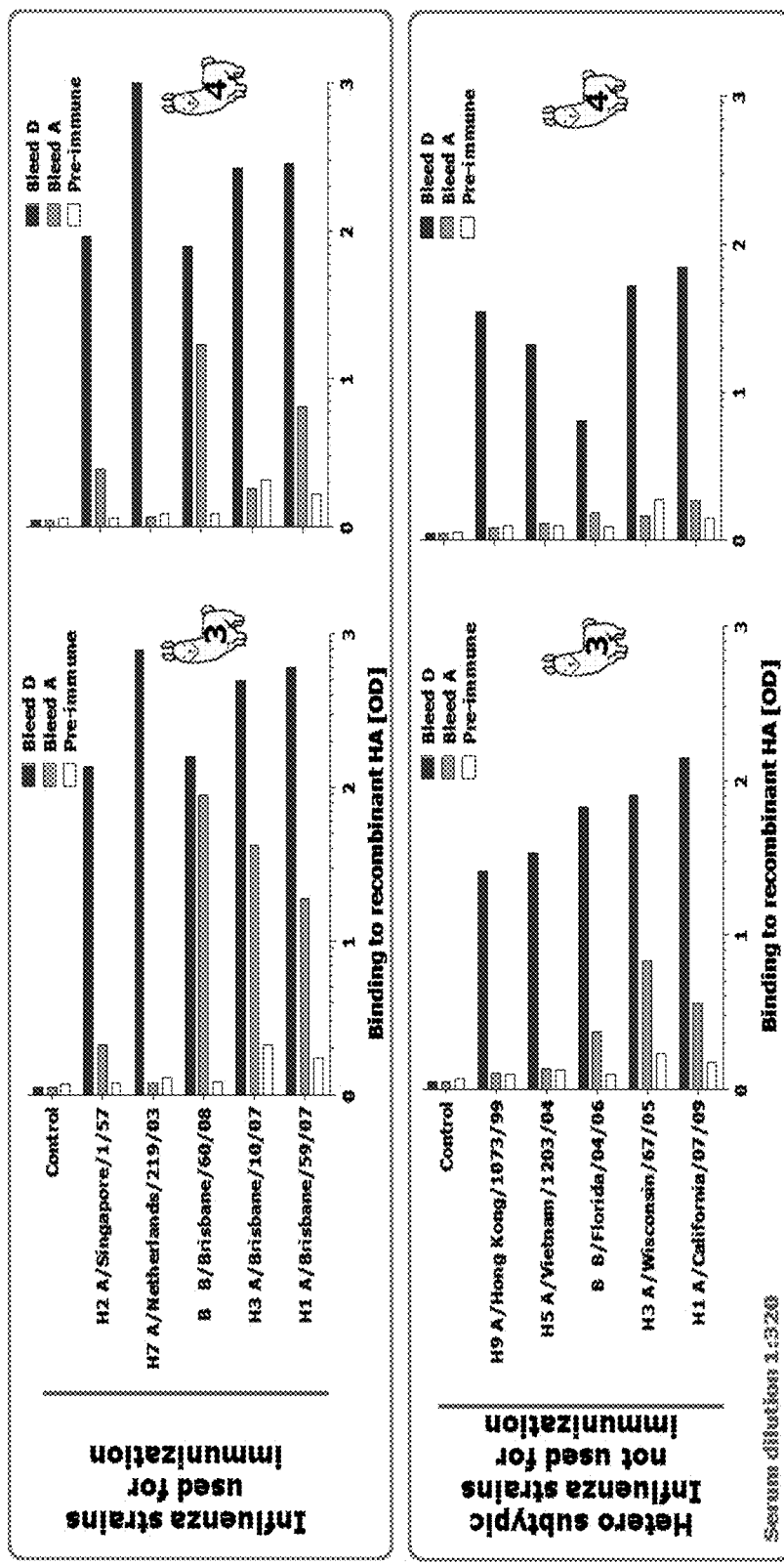
FIG. 1 shows the analysis of the immune response in llama #3 and #4 by ELISA.

Some definitions of terms as used in the present invention are given below:

The term "binding molecule" as used herein refers to both single domain antibodies (monomeric binding molecules) and multi-domain antibodies (multimeric binding molecules) according to the invention.

As used herein a single-domain antibody (sdAb) is a binding molecule consisting of a single monomeric variable antibody domain that specifically binds an antigen or epitope independently of other V regions or domains. Single domain antibodies are known in the art and are usually derived from naturally occurring "heavy chain only" antibodies, i.e. heavy chain antibodies devoid of light chains. Such heavy chain only antibodies can be obtained from Camelidae species, for example in camel, llama, dromedary, or alpaca (also referred to as camelid antibodies). The variable region derived from said heavy chain only antibody is generally known as a VHH domain or single domain antibody (sdAb). A single-domain antibody as used herein also refers to an isolated single variable domain (VL or VH) from a conventional immunoglobulin comprising two heavy chains and two light chains. This immunoglobulin is preferably human, but may also comprise immunoglobulins from other mammalian species including rodents.

As used herein the term "multi-domain antibody" refers to a binding molecule comprising at least two single domain antibodies, linked to each other either directly or by a linking sequence.

The term "influenza virus subtype" in relation to influenza A viruses refers to influenza A virus strains that are characterized by various combinations of the hemagglutinin (H) and neuraminidase (N) viral surface proteins. Influenza A virus subtypes may be referred to by their H number, such as for example "influenza virus comprising HA of the H1 or H3 subtype", or "H1 influenza virus" "H3 influenza virus", or by a combination of an H number and an N number, such as for example "influenza virus subtype "H3N2" or "H5N1". The term influenza virus "subtype" specifically includes all individual influenza virus "strains" within such subtype, which usually result from mutations and show different pathogenic profiles, and include natural isolates as well as man-made mutants or reassortants and the like. Such strains may also be referred to as various "isolates" of a viral subtype. Accordingly, as used herein, the terms "strains" and "isolates" may be used interchangeably.

The influenza A virus subtypes can further be classified by reference to their phylogenetic group. Phylogenetic analysis has demonstrated a subdivision of influenza hemagglutinins into two main groups: inter alia the H1, H2, H5 and H9 subtypes in phylogenetic group 1 ("group 1" influenza viruses) and inter alia the H3, H4, H7 and H10 subtypes in phylogenetic group 2 ("group 2" influenza viruses).

The antigenic variation in HA within the influenza type B virus strains is smaller than that observed within the type A strains. Two genetically and antigenically distinct subtypes, or "lineages", of influenza B virus are circulating in humans, as represented by the B/Yamagata/16/88 (also referred to as B/Yamagata) and B/Victoria/2/87 (B/Victoria) lineages. As used herein the influenza B virus strains are referred to as influenza virus strains derived from the "the B/Yamagata lineage" or the "BNictoria lineage".

The term "neutralizing" as used herein in relation to the binding molecules of the invention refers to binding molecules that inhibit an influenza virus from replication, in vitro and/or in vivo within a subject, regardless of the mechanism by which neutralization is achieved. Thus, neutralization can e.g. be achieved by inhibiting the attachment or adhesion of the virus to the cell surface, or by inhibition of the fusion of viral and cellular membranes following attachment of the virus to the target cell, or by inhibiting viral egress from infected cells, and the like. The term "cross-neutralizing" or "cross-neutralization" as used herein in relation to the binding molecules of the invention refers to the ability of the binding molecules of the invention to neutralize different subtypes of influenza A and/or B viruses.

With respect to the binding molecules of the invention, the term "(immuno)specifically binding" refers to binding molecules that bind to an epitopes of a protein of interest, but which do not substantially recognize and bind other molecules in a sample containing a mixture of antigenic biological molecules. The binding may be mediated by covalent or non-covalent interactions or a combination of both.

As used herein, the term "influenza", or "influenza virus disease" refers to the pathological condition resulting from an infection of a cell or a subject by an influenza A or B virus. In specific embodiments, the term refers to a respiratory illness caused by an influenza A or B virus. As used herein, the term "influenza virus infection" means the invasion by, multiplication and/or presence of an influenza virus in a cell or a subject.

DETAILED DESCRIPTION OF THE INVENTION

In a first aspect of the invention, novel single domain antibodies (sdAbs) capable of specifically binding to hemagglutinin (HA) of at least two influenza A virus strains comprising HA of two different subtypes from phylogenetic group 2 are provided, i.e. sdAbs capable of specifically binding to hemagglutinin (HA) of at least two different influenza A virus strains, said strains comprising HA from two different HA subtypes from phylogenetic group 2. In addition, sdAbs that are capable of binding to HA of at least one influenza A virus strain from phylogenetic group 1 and to HA of at least one influenza A virus strain from phylogenetic group 2 are provided. Furthermore, sdAbs capable of specifically binding to HA of at least one influenza B virus strain are provided. Single domain antibodies that are capable of specifically binding to HA of two different subtypes of influenza A virus strains from phylogenetic group 2, or capable from binding to HA of influenza A virus strains from both phylogenetic group 1 (such as influenza viruses comprising HA of the H1, H2, and/or H5 subtype) and phylogenetic group 2 (such as influenza viruses comprising HA of the H3, H7 and/or H10 subtype) have not been described before. In addition, sdAbs that are capable of specifically binding to HA of influenza B viruses have also not yet been described.

The sdAbs of the invention bind to conserved neutralizing epitopes in HA. In certain embodiments, the sdAbs bind to an epitope in the stem region of the HA protein of an influenza A or B virus. In other embodiments, the sdAbs bind to an epitope in the head region of the HA protein. In certain embodiments, the sdAb binds to an epitope in the head region of the HA protein of an influenza B viruses.

In certain preferred embodiments, the sdAbs are also capable of neutralizing at least two influenza A virus strains comprising HA of two different subtypes from phylogenetic group 2. In certain embodiments, the sdAbs are capable of neutralizing preferably at least one influenza A virus strain from phylogenetic group 1 (such as e.g. an influenza virus comprising HA of the H1 or H5 subtype) and at least one influenza A virus strain from phylogenetic group 2 (such as e.g. an influenza virus comprising HA of the H3 or H7 subtype); or at least one influenza B virus strain, preferably at least one influenza B virus strain from the B/Yamagata lineage and at least one influenza virus strain from the B/Victoria lineage.

In certain embodiments, the single domain antibody according to the invention is a Camelid VHH domain, i.e. a variable domain of a so-called Camelid (heavy chain only) antibody. In further embodiments, the single domain antibody is a humanized Camelid VHH domain. Humanization of Camelid single domain antibodies requires the introduction and mutagenesis of a limited amount of amino acids in a single polypeptide chain. This is in contrast to humanization of scFv, Fab, (Fab) 2 and IgG, which requires the introduction of amino acid changes in two chains, the light and the heavy chain, and the preservation of the assembly of both chains. Methods for humanization of the camelid VHH domains are known in the art, such as for example described in WO2008/020079, WO2008/142164, WO2010/139808. Humanization of the sdAbs according to the present invention is described in Example 11.

In certain embodiments, a single domain antibody of the invention comprises: one or more of CDR sequences selected from SEQ ID NO: 227, 228 and 229;
one or more of CDR sequences selected from SEQ ID NO: 230, 231 and 232;
one or more of CDR sequences selected from SEQ ID NO: 233, 234 and 235;
one or more of CDR sequences selected from SEQ ID NO: 236, 237 and 238;
one or more of CDR sequences selected from SEQ ID NO: 239, 240 and 241;
one or more of CDR sequences selected from SEQ ID NO: 242, 243 and 244;
one or more of CDR sequences selected from SEQ ID NO: 245, 246 and 247;
one or more of CDR sequences selected from SEQ ID NO: 248, 249, and 250;
one or more of CDR sequences selected from SEQ ID NO: 251, 252 and 253;

one or more of CDR sequences selected from SEQ ID NO: 254, 255 and 256;
one or more of CDR sequences selected from SEQ ID NO: 257, 258 and 259;
one or more of CDR sequences selected from SEQ ID NO: 260, 261 and 262;
one or more of CDR sequences selected from SEQ ID NO: 263, 264 and 265;
one or more of CDR sequences selected from SEQ ID NO: 266, 267 and 268;
one or more of CDR sequences selected from SEQ ID NO: 269, 270 and 271;
one or more of CDR sequences selected from SEQ ID NO: 272, 273 and 274;
one or more of CDR sequences selected from SEQ ID NO: 275, 276 and 277;
one or more of CDR sequences selected from SEQ ID NO: 278, 279 and 280;
one or more of CDR sequences selected from SEQ ID NO: 281, 282 and 283;
one or more of CDR sequences selected from SEQ ID NO: 284, 285 and 286;
one or more of CDR sequences selected from SEQ ID NO: 287, 288 and 289;
one or more of CDR sequences selected from SEQ ID NO: 290, 291 and 292;
one or more of CDR sequences selected from SEQ ID NO: 293, 122 and 123;
one or more of CDR sequences selected from SEQ ID NO: 124, 125 and 126;
one or more of CDR sequences selected from SEQ ID NO: 127, 128 and 129;
one or more of CDR sequences selected from SEQ ID NO: 130, 131 and 132;
one or more of CDR sequences selected from SEQ ID NO: 133, 134 and 135;
one or more of CDR sequences selected from SEQ ID NO: 136, 137 and 138; or
one or more of CDR sequences selected from SEQ ID NO: 139, 140 and 141.

The term "complementarity determining regions" (CDR) as used herein means sequences within the variable regions of binding molecules, that usually contribute to a large extent to the antigen binding site which is complementary in shape and charge distribution to the epitope recognized on the antigen. The CDR regions can be specific for linear epitopes, discontinuous epitopes, or conformational epitopes of proteins or protein fragments, either as present on the protein in its native conformation or, in some cases, as present on the proteins as denatured, e.g., by solubilization in SDS.

In certain embodiments, the single domain antibody is selected from the group consisting of:
a) a single domain antibody comprising a CDR1 region of SEQ ID NO:227, a CDR2 region of SEQ ID NO: 228, and a CDR3 region of SEQ ID NO: 229;
b) a single domain antibody comprising a CDR1 region of SEQ ID NO:230, a CDR2 region of SEQ ID NO: 231, and a CDR3 region of SEQ ID NO: 232;
c) a single domain antibody comprising a CDR1 region of SEQ ID NO:233, a CDR2 region of SEQ ID NO: 234, and a CDR3 region of SEQ ID NO: 235;
d) a single domain antibody comprising a CDR1 region of SEQ ID NO:236, a CDR2 region of SEQ ID NO: 237, and a CDR3 region of SEQ ID NO: 238;
e) a single domain antibody comprising a CDR1 region of SEQ ID NO:239, a CDR2 region of SEQ ID NO: 240, and a CDR3 region of SEQ ID NO: 241;
f) a single domain antibody comprising a CDR1 region of SEQ ID NO:242, a CDR2 region of SEQ ID NO: 243 and a CDR3 region of SEQ ID NO: 244;
g) a single domain antibody comprising a CDR1 region of SEQ ID NO:245, a CDR2 region of SEQ ID NO: 245, and a CDR3 region of SEQ ID NO: 247;
h) a single domain antibody comprising a CDR1 region of SEQ ID NO:248, a CDR2 region of SEQ ID NO: 249, and a CDR3 region of SEQ ID NO: 250;
i) a single domain antibody comprising a CDR1 region of SEQ ID NO: 251, a CDR2 region of SEQ ID NO: 252, and a CDR3 region of SEQ ID NO: 253;
j) a single domain antibody comprising a CDR1 region of SEQ ID NO:254, a CDR2 region of SEQ ID NO: 255, and a CDR3 region of SEQ ID NO: 256;
k) a single domain antibody comprising a CDR1 region of SEQ ID NO:257, a CDR2 region of SEQ ID NO: 258, and a CDR3 region of SEQ ID NO: 259;
l) a single domain antibody comprising a CDR1 region of SEQ ID NO: 260, a CDR2 region of SEQ ID NO: 261 and a CDR3 region of SEQ ID NO: 262;
m) a single domain antibody comprising a CDR1 region of SEQ ID NO: 263, a CDR2 region of SEQ ID NO: 264, and a CDR3 region of SEQ ID NO: 265;
n) a single domain antibody comprising a CDR1 region of SEQ ID NO: 266, a CDR2 region of SEQ ID NO: 267, and a CDR3 region of SEQ ID NO: 268;
o) a single domain antibody comprising a CDR1 region of SEQ ID NO: 269, a CDR2 region of SEQ ID NO: 270, and a CDR3 region of SEQ ID NO: 271;
p) a single domain antibody comprising a CDR1 region of SEQ ID NO: 272, a CDR2 region of SEQ ID NO: 273, and a CDR3 region of SEQ ID NO: 274;
q) a single domain antibody comprising a CDR1 region of SEQ ID NO: 275, a CDR2 region of SEQ ID NO: 276, and a CDR3 region of SEQ ID NO: 277;
r) a single domain antibody comprising a CDR1 region of SEQ ID NO: 278, a CDR2 region of SEQ ID NO: 279 and a CDR3 region of SEQ ID NO: 280;
s) a single domain antibody comprising a CDR1 region of SEQ ID NO: 281, a CDR2 region of SEQ ID NO: 282, and a CDR3 region of SEQ ID NO: 283;
t) a single domain antibody comprising a CDR1 region of SEQ ID NO: 284, a CDR2 region of SEQ ID NO: 285, and a CDR3 region of SEQ ID NO: 286;
u) a single domain antibody comprising a CDR1 region of SEQ ID NO: 287, a CDR2 region of SEQ ID NO: 288, and a CDR3 region of SEQ ID NO: 289;
v) a single domain antibody comprising a CDR1 region of SEQ ID NO: 290, a CDR2 region of SEQ ID NO: 291, and a CDR3 region of SEQ ID NO: 292;
w) a single domain antibody comprising a CDR1 region of SEQ ID NO: 293, a CDR2 region of SEQ ID NO: 122, and a CDR3 region of SEQ ID NO: 123;
x) a single domain antibody comprising a CDR1 region of SEQ ID NO:124, a CDR2 region of SEQ ID NO: 125 and a CDR3 region of SEQ ID NO: 126;
y) a single domain antibody comprising a CDR1 region of SEQ ID NO: 127, a CDR2 region of SEQ ID NO: 128, and a CDR3 region of SEQ ID NO: 129;
z) a single domain antibody comprising a CDR1 region of SEQ ID NO:130, a CDR2 region of SEQ ID NO: 131, and a CDR3 region of SEQ ID NO: 132;

aa) a single domain antibody comprising a CDR1 region of SEQ ID NO:133, a CDR2 region of SEQ ID NO: 134, and a CDR3 region of SEQ ID NO: 135;
bb) a single domain antibody comprising a CDR1 region of SEQ ID NO:136, a CDR2 region of SEQ ID NO: 137, and a CDR3 region of SEQ ID NO: 138; and
cc) a single domain antibody comprising a CDR1 region of SEQ ID NO:139, a CDR2 region of SEQ ID NO: 140, and a CDR3 region of SEQ ID NO: 141.

In certain preferred embodiments, the single domain antibody is selected from the group consisting of:
a) a single domain antibody comprising a CDR1 region of SEQ ID NO: 275, a CDR2 region of SEQ ID NO: 276, and a CDR3 region of SEQ ID NO: 277;
b) a single domain antibody comprising a CDR1 region of SEQ ID NO: 284, a CDR2 region of SEQ ID NO: 285, and a CDR3 region of SEQ ID NO: 286;
c) a single domain antibody comprising a CDR1 region of SEQ ID NO:124, a CDR2 region of SEQ ID NO: 125 and a CDR3 region of SEQ ID NO: 126;
d) a single domain antibody comprising a CDR1 region of SEQ ID NO: 127, a CDR2 region of SEQ ID NO: 128, and a CDR3 region of SEQ ID NO: 129;
e) a single domain antibody comprising a CDR1 region of SEQ ID NO: 263, a CDR2 region of SEQ ID NO: 264, and a CDR3 region of SEQ ID NO: 265; and
f) a single domain antibody comprising a CDR1 region of SEQ ID NO: 133, a CDR2 region of SEQ ID NO: 134, and a CDR3 region of SEQ ID NO: 135.

According to a further embodiment, a single domain antibody according to the invention comprises an amino acid sequence selected from the group consisting of SEQ ID NO: 1-29, or a homologous amino acid sequence. As used herein, a homologous amino acid sequence of the present invention may comprise additions, deletions or substitutions of one or more amino acids, which do not substantially alter the functional characteristics of the binding molecules of the invention. Where homologous sequence indicates sequence identity, it means a sequence which presents a high sequence identity (more than 70%, 75%, 80%, 85%, 90%, 95% or 98% sequence identity) with the parent sequence.

In certain embodiments, one or more amino acids in amino acid sequences described herein may be mutated, i.e. substituted by another amino acid. Such mutations may be introduced to prevent the occurrence of post-translational modifications. The most prevalent modifications include proteolysis, glycosylation, oxidation of methionine, and deamidation of asparagine and glutamine residues. Other modifications include pyroglutamate formation, aspartate isomerization and tryptophan oxidation. The following amino acid residues and sequence motifs are susceptible to post-translational modification and may therefore be altered by site directed mutagenesis: N-terminal glutamic acid or glutamine, N-glycosylation motif Asn-Xxx-Ser/Thr, solvent exposed methionine or tryptophan residues, proteolytic cleavage site Asp-Pro, deamidation motifs Asn-Gly and Gln-Gly and/or Asp isomerization motif Asp-Gly.

In certain embodiments, a sdAb of the invention is humanized. Thus, in certain embodiments, the sdAbs comprise an amino acid sequence selected from the group consisting of SEQ ID NO: 146-226 and 340.

In certain embodiments, the single domain antibody according to the invention comprises an amino acid sequence selected from the group consisting of SEQ ID NO: 13, or a humanized variant thereof selected from the group consisting of SEQ ID NO: 177-187 and SEQ ID NO: 340; SEQ ID NO: 17 or a humanized variant thereof selected from the group consisting of SEQ ID NO: 146-156; SEQ ID NO: 20 or a humanized variant thereof selected from the group consisting of SEQ ID NO: 157-176; SEQ ID NO: 24 or a humanized variant thereof selected from the group consisting of SEQ ID NO: 188-197; SEQ ID NO: 25 or a humanized variant thereof selected from the group consisting of SEQ ID NO: 198-203; and SEQ ID NO: 27 or a humanized variant thereof selected from the group consisting of SEQ ID NO: 204-226.

In certain embodiments, the single domain antibody comprises an amino acid sequence selected from the group consisting of: SEQ ID NO: 187, SEQ ID NO: 340, SEQ ID NO: 155, SEQ ID NO: 176, SEQ ID NO: 197, SEQ ID NO: 203 and SEQ ID NO: 221.

According to second aspect of the present invention so-called multi-domain antibodies, i.e. binding molecules comprising at least two single domain antibodies as described above, are provided. For example, the C-terminal end of a first single domain antibody may be linked to the N-terminal end of a next single domain antibody to form a dimeric binding molecule. In certain embodiments, the multi-domain antibodies comprise at least three, at least four, or at least five single domain antibodies as described above to form a multimer, such as a trimer, tetramer, pentamer, etc. The linked sdAbs can be the same or can be different sdAbs, i.e. sdAbs having different amino acid sequences and epitope specificities.

In certain embodiments, the multi-domain antibodies are single chain molecules. In certain embodiments, the multi-domain antibodies are two-chain molecules, i.e. comprise at least two chains each comprising at least one single-domain antibody. The two chains may be identical or may be different.

The single domain antibodies may be linked to form any of the multi-domain antibodies disclosed herein using any methods known in the art. Thus, the single domain antibodies may be linked by chemical linkage, or may be linked together either directly or by short polypeptide linkers. Such linker sequence may be a naturally occurring sequence or a non-naturally occurring sequence. The linker sequence preferably provides sufficient flexibility to the multi-domain antibody and at the same time is resistant to proteolytic degradation.

In certain embodiment, the at least two single domain antibodies are genetically fused via peptide linkers. Thus, the single domain antibodies are fused genetically at the DNA level, by forming a polynucleotide construct (or nucleic acid sequence) encoding the complete polypeptide construct, i.e. the binding molecule comprising the two or more single domain antibodies.

In certain embodiments, the at least two single domain antibodies are linked by a linking sequence comprising from 1 to 100 amino acids, preferably from 1 to 80 amino acids, or from 1 to 60 amino acids, or from 10 to 60 amino acids. Examples of linkers include, but are not limited to, the linking sequences in Table 15. Thus, in certain embodiments the linking sequence comprises an amino acid sequence selected from SEQ ID NO: 142-145.

In certain embodiments, the multi-domain antibodies comprise at least two sdAbs according to the present invention. The at least two sdAbs may be selected from Table 14 and/or Table 40. In certain embodiments, the at least two sdAbs are selected from the group consisting of SEQ ID NO: 1-29 and SEQ ID NO: 146-226. The at least two sdAbs may be the same (homo-multimer) or may be different (hetero-multimer).

In certain embodiments, the multi-domain antibodies comprise at least two, preferably at least three, more preferably at least four sdAbs selected from the group consisting of
a) a single domain antibody comprising a CDR1 region of SEQ ID NO: 275, a CDR2 region of SEQ ID NO: 276, and a CDR3 region of SEQ ID NO: 277;
b) a single domain antibody comprising a CDR1 region of SEQ ID NO: 284, a CDR2 region of SEQ ID NO: 285, and a CDR3 region of SEQ ID NO: 286;
c) a single domain antibody comprising a CDR1 region of SEQ ID NO:124, a CDR2 region of SEQ ID NO: 125 and a CDR3 region of SEQ ID NO: 126;
d) a single domain antibody comprising a CDR1 region of SEQ ID NO: 127, a CDR2 region of SEQ ID NO: 128, and a CDR3 region of SEQ ID NO: 129;
e) a single domain antibody comprising a CDR1 region of SEQ ID NO: 263, a CDR2 region of SEQ ID NO: 264, and a CDR3 region of SEQ ID NO: 265; and
f) a single domain antibody comprising a CDR1 region of SEQ ID NO: 133, a CDR2 region of SEQ ID NO: 134, and a CDR3 region of SEQ ID NO: 135.

In certain embodiments, the multi-domain antibodies according to the invention comprise at least two, preferably at least three, more preferably at least four sdAbs selected from the group consisting of: SEQ ID NO: 13, or a humanized variant thereof selected from the group consisting of SEQ ID NO: 177-187 and SEQ ID NO: 340; SEQ ID NO: 17 or a humanized variant thereof selected from the group consisting of SEQ ID NO: 146-156; SEQ ID NO: 20 or a humanized variant thereof selected from the group consisting of SEQ ID NO: 157-176; SEQ ID NO: 24 or a humanized variant thereof selected from the group consisting of SEQ ID NO: 188-177; SEQ ID NO: 25 or a humanized variant thereof selected from the group consisting of SEQ ID NO: 198-203; and SEQ ID NO: 27 or a humanized variant thereof selected from the group consisting of SEQ ID NO: 204-226.

In certain embodiments, the multi-domain antibodies according to the invention comprise an amino acid sequence selected from the group consisting of: SEQ ID NO: 30-73.

In certain embodiments, the multi-domain antibodies of the invention are capable of neutralizing at least one influenza A virus strain from phylogenetic group 1 (such as e.g. an influenza virus comprising HA of the H1 and/or H5 subtype) and at least one influenza A virus strain from phylogenetic group 2 (such as e.g. an influenza virus comprising HA of the H3 and/or H7 subtype). In certain embodiments, the multi-domain antibodies of the invention are capable of neutralizing at least one influenza A virus strain from phylogenetic group 1 (such as e.g. an influenza virus comprising HA of the H1 and/or H5 subtype) and at least one influenza A virus strain from phylogenetic group 2 (such as e.g. an influenza virus comprising HA of the H3 and/or H7 subtype) and at least one influenza B virus strain, preferably at least one influenza B virus strain of the B/Yamagata lineage and at least one influenza virus strain of the B/Victoria lineage.

In certain embodiments, the multi-domain antibodies are capable of neutralizing influenza viruses comprising HA of the H1 subtype (such as H1N1 influenza virus strains), influenza viruses comprising HA of the H3 subtype (such as H3N2 influenza virus strains), influenza viruses comprising HA of the H5 subtype (such as H5N1 influenza virus strains), influenza viruses comprising HA of the H7 subtype (such as H7N9 influenza virus strains), and at least one influenza B virus, preferably at least one influenza B virus strain from the B/Yamagata lineage and at least one influenza virus strain from the B/Victoria lineage. The multi-domain antibodies of the present invention thus can suitably be used in the prevention and/or treatment of influenza infections, even irrespective of the causative influenza subtype.

According to the present invention it has been shown that the cross-neutralizing multi-domain antibodies of the invention offer several advantages relative to other small and large anti-influenza molecules. Thus, the affinity and potency of the multi-domain antibodies, as well as the breadth of neutralization are superior to the affinity, potency and breadth of neutralization of the published broadly neutralizing Abs (bnAbs) targeting influenza HA, like e.g. CR9114 (WO2013/007770) and FI6v3 (Corti et al., 2011). In addition, the multi-domain antibodies by targeting multiple independent neutralizing epitopes are less prone to the development of drug resistant influenza strains than CR9114 and FI6v3.

As described herein, the present invention thus provides novel influenza binding and cross-neutralizing binding molecules. The binding molecules may be monomeric, i.e. be single domain antibodies, or multimeric, i.e. multi-domain antibodies. The binding molecules of the invention bind to their target with high affinity and specificity. This is in contrast with small molecule drugs like antivirals which frequently show off-target binding resulting in unwanted side effects. In addition, the binding molecules of the invention bind to a variety of HA epitopes, some of which are inaccessible to conventional antibodies. Influenza HA contains multiple glycosylation sites both in the head and stem region. Carbohydrates attached to these sites render some parts on the HA molecule inaccessible to conventional antibodies. The smaller binding molecules of the invention are still able to target these potentially functionally important epitopes. In addition, the binding molecules of the invention are stable under a wide range of extreme conditions. They are typically resistant to elevated temperatures (up to 100° C.), extremes in pH, denaturing agents and proteolytic degradation. The favorable stability of the binding molecules may yield products that can be kept outside of the cold chain and that have longer shelf-lives than other protein drugs like monoclonal antibodies. Furthermore, the binding molecules of the invention are all single proteins which can be produced and purified following one single process.

Typically, the binding molecules according to the invention bind to HA of an influenza A virus of group 1 (such as H1N1) and/or an influenza A virus of group 2 (such as H3N2), and/or an influenza B virus, and/or fragments thereof, with an affinity constant (Kd-value) that is lower than $1.0 \times 10^{-6}$ M, $1.0 \times 10^{-7}$ M, preferably lower than $1.0 \times 10^{-8}$ M, more preferably lower than $1.0 \times 10^{-9}$ M. Affinity constants can for instance be measured using surface plasmon resonance, for example using the BIACORE system (Pharmacia Biosensor AB, Uppsala, Sweden), or as described in Example 8.

In certain embodiments, the binding molecules exhibit neutralization activity against influenza A and/or B viruses. In certain embodiment, the binding molecules of the invention prevent an influenza A or B virus from infecting host cells by at least 99%, at least 95%, at least 90%, at least 85%, at least 80%, at least 75%, at least 70%, at least 60%, at least 50%, at least 45%, at least 40%, at least 45%, at least 35%, at least 30%, at least 25%, at least 20%, or at least 10% relative to infection of host cells by said influenza virus in the absence of said binding molecules. Neutralizing activity can for instance be measured as described herein. Alternative assays measuring neutralizing activity are described in for instance WHO Manual on Animal Influenza Diagnosis and Surveillance, Geneva: World Health Organisation, 2005, version 2002.5. Typically, the binding molecules according to the invention have a neutralizing activity of 1000 nM or less, preferably 100 nM or less, more preferably a neutralizing activity of 10 nM or less, even more preferably 1 nM or less, as determined in an in vitro virus neutralization assay (VNA), e.g. as described in the Examples.

In certain embodiments, the binding molecules (i.e. the single domain antibodies or multi-domain antibodies) further comprise an Fc tail. Thus, in certain embodiments, the binding molecules, as described above, are linked to an Fc fragment of an antibody, preferably a human antibody, such as the Fc fragment of a human IgG antibody, e.g an IgG1, IgG2, IgG3, IgG4, or IgG4. According to the invention, the monomeric or multimeric binding molecules, as described herein, may be genetically fused to an Fc fragment, either directly or using a linker. In certain embodiments, the binding molecules are linked to the Fc fragment by a linking sequence comprising from 1 to 100 amino acids, preferably from 1 to 80 amino acids, or from 1 to 60 amino acids, or from 10 to 60 amino acids. Examples of linkers include, but are not limited to, the linking sequences in Table 15. Thus, in certain embodiments the linking sequence comprises an amino acid sequence selected from SEQ ID NO: 142-145. In certain embodiments, a sdAb or multi-domain antibody is genetically fused to the C-terminus of an Fc fragment. In further embodiments, a single domain antibody or multi-domain antibody is fused to both the N- and the C-terminus of an Fc fragment.

In certain embodiments, the Fc fragment is engineered to have minimal effector functions. Fc fragments with minimal effector function and conserved half-life have been described in the art and include e.g. IgG2, aglycosylated IgG1 (IgG1 agly), IgG4 with S228P/L234A/L235A substitutions (IgG4 ProAlaAla), IgG2 with H268Q/309L/A330S/P331S changes (IgG2m4) and an Fc variant of IgG2, designated as IgG2σ, containing V234A/G237A/P238S/H268A/V309L/A330S/P331S substitutions. With regard to mutated versions of IgG4, specific affinity for FcγR has been eliminated by the L234A/L245A substitutions.

In certain embodiments, the Fc fragment is engineered to have enhanced effector functions. The binding molecules of the invention thus can be engineered to enhance Fc-mediated effector functions, which in preclinical models of influenza infection have been shown to contribute to drug efficacy. Several mutations in the CH2 domain of human IgG1 associated with enhanced effector function have been described in the art. These mutations include, but are not limited to, alanine mutant at position 333 which increases both ADCC and CDC, a triple mutant (S239D/I332E/A330L) with higher affinity for FcγRIIIa and lower affinity for FcγRIIb resulting in enhanced ADCC, and another triple mutant (S239D/I332E/G236A) with improved FcγRIIIa affinity and FcγRIIa/FcγRIIb ratio that mediates enhanced phagocytosis. Other Fc mutations affecting effector functionality have been described in literature e.g. Strohl, 2009. In certain embodiments, the Fc fragment is engineered to have an extended serum half-life. Several engineered Fc backbones with increased serum half-life are known in the art. These Fc variants include, but are not limited to, hIgG1 Fc with M252Y/S254T/T256E (YTE) mutations, hIgG1 or hIgG2 Fc carrying T250Q/M428L mutations (QL), hIgG1 Fc with N434A mutation, hIgG1 Fc with T307A/E380A/N434A mutations (AAA) or hIgG1 Fc with M428L/N434S (LS) substitutions (Kuo et al., 2011). In further embodiments, the binding molecules (i.e. the single domain antibodies or the multi-domain antibodies according to the invention) are genetically fused to human serum albumin or a single domain antibody binding to serum albumin. In other embodiments, the single domain antibodies or the multi-domain antibodies according to the invention are chemically conjugated to PEG. The binding molecules of the invention thus can be engineered to have serum half-lives ranging from e.g. just a few hours to several weeks or even months. This opens the possibility for single dose treatment of influenza infection instead of a 2× daily regimen as currently used form the neuraminidase inhibitors, such as oseltamivir and zanamivir.

In further embodiments, the single domain antibody or multi-domain antibody as described above may be fused to an Fc tail, preferably an Fc tail which is engineered to promote the formation of a hetero-dimeric Fc molecule. Mutations promoting Fc-heterodimerization have been described in the art (Klein et al., 2012). In certain embodiments, the mutations promoting the FC-heterodimerization are the knobs-into-holes mutations as described in EP0812357B1 and EP0979281B1.

In certain embodiments, the multi-domain antibodies according to the present invention comprise at least one chain comprising an amino acid sequence selected from the group consisting of SEQ ID NO: 74-107, SEQ ID NO: 110-121 and SEQ ID NO: 293-339.

In certain embodiments, the multi-domain antibodies comprise two chains, wherein the amino acid sequence of the two chains is identical. In certain embodiments, the two chains comprise an amino acid sequence selected from the group consisting of SEQ ID NO: 74-105 and SEQ ID NO: 293-298. In certain embodiments, the two amino acid chains comprise an amino acid sequence of SEQ ID NO: 293-298.

In certain embodiments, the multi-domain antibodies comprise two different amino acid chains. In certain embodiments, the two different amino acid chains are selected from the group consisting of:

one chain comprising the amino acid sequence of SEQ ID NO: 299 and one chain comprising the amino acid sequence of SEQ ID NO: 300;

one chain comprising the amino acid sequence of SEQ ID NO: 301 and one chain comprising the amino acid sequence of SEQ ID NO: 302;

one chain comprising the amino acid sequence of SEQ ID NO: 303 and one chain comprising the amino acid sequence of SEQ ID NO: 305;

one chain comprising the amino acid sequence of SEQ ID NO: 306 and one chain comprising the amino acid sequence of SEQ ID NO: 307;

one chain comprising the amino acid sequence of SEQ ID NO: 308 and one chain comprising the amino acid sequence of SEQ ID NO: 309;

one chain comprising the amino acid sequence of SEQ ID NO: 310 and one chain comprising the amino acid sequence of SEQ ID NO: 311;

one chain comprising the amino acid sequence of SEQ ID NO: 312 and one chain comprising the amino acid sequence of SEQ ID NO: 313;

one chain comprising the amino acid sequence of SEQ ID NO: 315 and one chain comprising the amino acid sequence of SEQ ID NO: 315;

one chain comprising the amino acid sequence of SEQ ID NO: 316 and one chain comprising the amino acid sequence of SEQ ID NO: 317;

one chain comprising the amino acid sequence of SEQ ID NO: 318 and one chain comprising the amino acid sequence of SEQ ID NO: 319;

one chain comprising the amino acid sequence of SEQ ID NO: 106 and one chain comprising the amino acid sequence of SEQ ID NO: 317;

one chain comprising the amino acid sequence of SEQ ID NO: 320 and one chain comprising the amino acid sequence of SEQ ID NO: 321;

one chain comprising the amino acid sequence of SEQ ID NO: 322 and one chain comprising the amino acid sequence of SEQ ID NO: 323;

one chain comprising the amino acid sequence of SEQ ID NO: 324 and one chain comprising the amino acid sequence of SEQ ID NO: 325;

one chain comprising the amino acid sequence of SEQ ID NO: 326 one chain comprising the amino acid sequence of SEQ ID NO: 327;

one chain comprising the amino acid sequence of SEQ ID NO: 328 and one chain comprising the amino acid sequence of SEQ ID NO: 329;

one chain comprising the amino acid sequence of SEQ ID NO: 330 and one chain comprising the amino acid sequence of SEQ ID NO: 331;

one chain comprising the amino acid sequence of SEQ ID NO: 332 and one chain comprising the amino acid sequence of SEQ ID NO: 333;

one chain comprising the amino acid sequence of SEQ ID NO: 334 and one chain comprising the amino acid sequence of SEQ ID NO: 335;

one chain comprising the amino acid sequence of SEQ ID NO: 336 and one chain comprising the amino acid sequence of SEQ ID NO: 337; and one chain comprising the amino acid sequence of SEQ ID NO: 338 and one chain comprising the amino acid sequence of SEQ ID NO: 339.

In certain embodiments, the two different amino acid chains are selected from the group consisting of:

one chain comprising the amino acid sequence of SEQ ID NO: 301 and one chain comprising the amino acid sequence of SEQ ID NO: 302;

one chain comprising the amino acid sequence of SEQ ID NO: 310 and one chain comprising the amino acid sequence of SEQ ID NO: 311;

one chain comprising the amino acid sequence of SEQ ID NO: 322 and one chain comprising the amino acid sequence of SEQ ID NO: 323; and one chain comprising the amino acid sequence of SEQ ID NO: 330 and one chain comprising the amino acid sequence of SEQ ID NO: 331.

In yet another aspect, the present invention further provides nucleic acid molecules (also referred to as nucleic acid sequences) encoding the single domain antibodies or multi-domain antibodies as described above. Preferably, the nucleic acid sequences encode binding molecules comprising one or more of the CDR regions as described above.

In certain embodiments, the nucleic acid sequences encode a single domain antibody comprising an amino acid sequence selected from the group consisting of SEQ ID NO: 1-29, or a homologous amino acid sequence.

In certain embodiments, the nucleic acid sequences encode a single domain antibody comprising an amino acid sequence selected from the group consisting of SEQ ID NO: 146-226 and SEQ ID NO: 340, or a homologous amino acid sequence.

In certain embodiments, the nucleic acid sequences encode a multi-domain antibody comprising an amino acid sequence selected from the group consisting of SEQ ID NO: 30-107, SEQ ID NO: 110-121 and SEQ ID NO: 293-339, or a homologous amino acid sequence.

A nucleic acid sequence according to the invention refers to a polymeric form of nucleotides and includes RNA, mRNA, cDNA, genomic DNA, and synthetic forms and mixed polymers of the above. A nucleotide refers to a ribonucleotide, deoxynucleotide or a modified form of either type of nucleotide. The term also includes single- and double-stranded forms of DNA. The skilled man will appreciate that functional variants of these nucleic acid molecules are also intended to be a part of the present invention. Functional variants are nucleic acid sequences that can be directly translated, using the standard genetic code, to provide an amino acid sequence identical to that translated from the parental nucleic acid molecules.

In preferred embodiments, the nucleic acid molecules encoding the binding molecules according to the invention are codon-optimized for expression in yeast cells or mammalian cells, such as human cells. Methods of codon-optimization are known and have been described previously (e.g. WO 96/09378). A sequence is considered codon-optimized if at least one non-preferred codon as compared to a wild type sequence is replaced by a codon that is more preferred. Herein, a non-preferred codon is a codon that is used less frequently in an organism than another codon coding for the same amino acid, and a codon that is more preferred is a codon that is used more frequently in an organism than a non-preferred codon. The frequency of codon usage for a specific organism can be found in codon frequency tables, such as in website: www_kazusa_or_jp/codon. Preferably more than one non-preferred codon, preferably most or all non-preferred codons, are replaced by codons that are more preferred. Preferably the most frequently used codons in an organism are used in a codon-optimized sequence. Replacement by preferred codons generally leads to higher expression.

It will also be understood by a skilled person that numerous different nucleic acid molecules can encode the same polypeptide as a result of the degeneracy of the genetic code. It is also understood that skilled persons may, using routine techniques, make nucleotide substitutions that do not affect the amino acid sequence encoded by the nucleic acid molecules to reflect the codon usage of any particular host organism in which the polypeptides are to be expressed. Therefore, unless otherwise specified, a "nucleic acid sequence encoding an amino acid sequence" includes all nucleotide sequences that are degenerate versions of each other and that encode the same amino acid sequence. Nucleic acid sequences can be cloned using routine molecular biology techniques, or generated de novo by DNA synthesis, which can be performed using routine procedures by service companies having business in the field of DNA synthesis and/or molecular cloning (e.g. GeneArt, GenScript, Life Technologies, Eurofins).

The invention also provides vectors comprising at least one nucleic acid sequence as described above. The term "vector" refers to a nucleic acid molecule into which a second nucleic acid molecule can be inserted for introduction into a host cell where it will be replicated, and in some cases expressed. In other words, a vector is capable of transporting a nucleic acid molecule to which it has been linked. Cloning vectors as well as expression vectors are contemplated by the term "vector", as used herein. Certain vectors are capable of autonomous replication in a host into which they are introduced (e.g., vectors having a bacterial origin of replication can replicate in bacteria). Other vectors can be integrated into the genome of a host upon introduction into the host cell, and thereby are replicated along with the host genome. Vectors according to the invention can easily be made by methods well known to the person skilled in the art.

In certain embodiments, vectors comprising one or more nucleic acid molecules according to the invention operably linked to one or more expression-regulating nucleic acid sequences are provided. The term "expression-regulating nucleic acid sequence" as used herein refers to nucleic acid sequences necessary for and/or affecting the expression of an operably linked coding sequence in a particular host organism. The expression-regulating nucleic acid sequences, such as inter alia appropriate transcription initiation, termination, promoter, enhancer sequences; repressor or activator sequences; efficient RNA processing signals such as splicing and polyadenylation signals; sequences that stabilize cytoplasmic mRNA; sequences that enhance translation efficiency (e.g., ribosome binding sites); sequences that enhance protein stability; and when desired, sequences that enhance protein secretion, can be any nucleic acid sequence showing activity in the host organism of choice and can be derived from genes encoding proteins, which are either homologous or heterologous to the host organism. The identification and employment of expression-regulating sequences is routine to the person skilled in the art. Suitable vectors according to the invention are e.g. adenovectors, such as e.g. Ad26 or Ad35, adenoassociated vectors (AAV), lentivirus, alphavirus, paramyxovirus, vaccinia virus, herpes virus, retroviral vectors etc.

In certain embodiments, the vectors are used for gene therapy purposes, as for example described by Adam et al. (2014), Johnson et al. (2009) and Suscovich and Alter (2015).

The invention further provides host cells comprising a nucleic acid sequence encoding a single domain antibody or a multi-domain antibody as described herein. "Host cells", as used herein, refers to cells into which a vector such as a cloning vector or an expression vector has been introduced. The host cells can be prokaryotic or eukaryotic.

The present invention further provides pharmaceutical compositions comprising one or more single domain antibodies, multi-domain antibodies, nucleic acid molecules and/or vectors as described above. The pharmaceutical compositions of the invention may further comprise at least one pharmaceutically acceptable excipient. By "pharmaceutically acceptable excipient" is meant any inert substance that is combined with an active molecule such as a binding molecule according to the invention for preparing a suitable composition. The pharmaceutically acceptable excipient is an excipient that is non-toxic to recipients at the used dosages and concentrations, and is compatible with other ingredients of the formulation. Pharmaceutically acceptable excipients are widely applied and known in the art. The pharmaceutical composition according to the invention may further comprise at least one other therapeutic, prophylactic and/or diagnostic agent. Said further therapeutic and/or prophylactic agents may for example be agents that are also capable of preventing and/or treating an influenza virus infection, such as for example M2 inhibitors (e.g., amantidine, rimantadine) and/or neuraminidase inhibitors (e.g., zanamivir, oseltamivir). These can be used in combination with the binding molecules of the invention. "In combination" herein means simultaneously, as separate formulations, or as one single combined formulation, or according to a sequential administration regimen as separate formulations, in any order.

In a further aspect, the present invention provides single domain antibodies, multi-domain antibodies, nucleic acid molecules, and/or vectors as described herein for use in the diagnosis, prevention and/or treatment of an influenza infection. The invention furthermore provides the use of the single domain antibodies, multi-domain antibodies, nucleic acid molecules, and/or vectors as described herein in the manufacture of a medicament for the diagnosis, prevention and/or treatment of an influenza infection. Such infections can occur in small populations, but can also spread around the world in seasonal epidemics or, worse, in global pandemics where millions of individuals are at risk. The invention provides binding molecules that can neutralize the infection of influenza strains that cause such seasonal epidemics, as well as potential pandemics. Importantly, protection and treatment can be envisioned now with the binding molecules of the present invention irrespective of the causative influenza virus, as it has been disclosed that the binding molecules of the present invention are capable of cross-neutralizing various influenza subtypes of both phylogenetic group 1, encompassing e.g. H1, H2, H5, H6, H8, H9 and H11 subtypes, and phylogenetic group 2, encompassing e.g. H3, H4, H7 and H10 subtypes, as well as influenza B subtypes.

The invention further provides methods for preventing and/or treating influenza in a subject, comprising administering a therapeutically effective amount of a single domain antibody, multi-domain antibody, nucleic acid molecule, and/or vector as described herein to a subject in need thereof. The term "therapeutically effective amount" refers to an amount of the binding molecule or nucleic acid molecule as defined herein that is effective for preventing, ameliorating and/or treating a condition resulting from infection with an influenza virus. Ameloriation as used in herein may refer to the reduction of visible or perceptible disease symptoms, viremia, or any other measurable manifestation of influenza infection. Prevention encompasses inhibiting or reducing the spread of influenza virus or inhibiting or reducing the onset, development or progression of one or more of the symptoms.

Prevention and/or treatment may be targeted at patient groups that are susceptible to influenza infection. Such patient groups include, but are not limited to e.g., the elderly (e.g. ≥50 years old, ≥60 years old, and preferably ≥65 years old), the young (e.g. ≤5 years old, ≤1 year old), hospitalized patients and already infected patients who have been treated with an antiviral compound but have shown an inadequate antiviral response.

Dosage regimens can be adjusted to provide the optimum desired response (e.g., a therapeutic response). A suitable dosage range may for instance be 0.01-100 mg/kg body weight, preferably 0.1-50 mg/kg body weight, preferably 0.01-15 mg/kg body weight. Furthermore, for example, a single bolus may be administered, several doses may be administered over time, or the dose may be proportionally reduced or increased as deemed necessary.

The binding molecules, nucleic acid molecules and/or vectors according to the invention may be administered to a subject for example intravenously, intranasally, via oral inhalation, pulmonary, subcutaneously, intradermally, intravitreally, orally, intramuscularly etc. The optimal route of administration will be influenced by several factors including the physicochemical properties of the active molecules, the urgency of the clinical situation and the relationship of the plasma concentrations of the active molecules to the desired therapeutic effect.

The high stability of binding molecules of the invention opens up the possibility for alternative, needle-free delivery, such as by intranasal administration using nose drops or nasal spray or via inhalation using a nebulizer or dry-powder inhaler. In certain embodiments, a nucleic acid molecule or vector encoding at least one single or multi-domain antibody according to the invention thus is administered intranasally, as described for example by Limberis et al. (2013).

Unlike conventional antibodies and many other biopharmaceuticals, the binding molecules of the invention can be produced very efficiently in microbial systems. Examples of microbial host cells used in large-scale manufacturing are for example yeast (*P. pastoris*) and *E. coli*. These microbial systems are considered as the most cost-effective option for biopharmaceutical manufacturing. Low COGs is a prerequisite for broad use of anti-flu drugs in influenza prophylaxis and treatment. In certain embodiments, the present invention thus provides methods for producing the binding molecules (i.e. the single domain antibodies or multi-domain antibodies) according to the invention, comprising culturing a host cell as described herein under conditions conducive to the expression of the binding molecule, and optionally, recovering the expressed binding molecule. Methods to recover the binding molecules from culture media are well known to the man skilled in the art.

In certain embodiment, the host cells are microbial cells, such as, but not limited to, yeast cells or *E. coli*.

In further embodiments, the host cells are mammalian cells, such as, but not limited to, CHO cells, HEK cells or PER.C6 cells.

The present invention further pertains to a method of detecting an influenza virus in a sample, wherein the method comprises the steps of a) contacting said sample with a diagnostically effective amount of a binding molecule according to the invention, and b) determining whether the binding molecule specifically binds to a molecule in the sample. The sample may be a biological sample including, but not limited to blood, serum, tissue or other biological material from (potentially) infected subjects. The (potentially) infected subjects may be human subjects, but also animals that are suspected as carriers of influenza virus might be tested for the presence of influenza virus using the binding molecules of the invention. Preferably, the binding molecules of the invention are contacted with the sample under conditions which allow the formation of an immunological complex between the binding molecules and the influenza virus or antigenic components thereof that may be present in the sample. The formation of an immunological complex, if any, indicating the presence of influenza virus in the sample, can then detected and measured by suitable means.

Such methods include, inter alia, homogeneous and heterogeneous binding immunoassays, such as radioimmunoassays (RIA), ELISA, immunofluorescence, immunohistochemistry, FACS, BIACORE and Western blot analyses. The present invention is further illustrated in the following, non-limiting Examples.

EXAMPLES

Example 1: Immunizations

With the aim to induce a heavy-chain antibody dependent immune response, four llamas (*Lama glama*) were immunized with influenza virus antigens (commercial vaccine Inflexal® and recombinant protein) in the presence of Freund's adjuvant according to the scheme described in Table 1.

TABLE 1

Llama immunization scheme.

| | Immu. 1 | Immu. 2 | Large bleed A(1) | Immu. 3 | Large bleed B (2) | Immu. 4 | Large bleed C (3) | Immu. 5 | Final bleed D (4) |
|---|---|---|---|---|---|---|---|---|---|
| Day | 1 | 14 | 28 | 28 | 42 | 42 | 63 | 102 | 112 |
| 4 Llamas | Inflexal (1 dose) SC, CFA | Inflexal (1 dose) SC, IFA | 250 mL | Inflexal (1 dose) + rH7 (50 µg) SC, IFA | 250 mL | rH7 (100 µg) SC, IFA | 100 mL | rH7 + rH2 (2 × 50 µg) SC, IFA | 250 mL |

Inflexal 09/10: A/Brisbane/59/2007(H1N1), A/Brisbane/10/2007 (H3N2), B/Brisbane/60/2008;
H1N1 virus: A/New Caledonia/20/99;
rH: recombinant HA protein from Protein Sciences;
rH1: A/New Caledonia/20/99;
rH7: A/Netherlands/219/03;
rH2: A/Japan/305/1957;
B1: B/Florida/04/06;
B2: B/Brisbane/60/08;
Immu.: Immunization;
SC: subcutaneous;
CFA: Complete Freund Adjuvant;
IFA: Incomplete Freund Adjuvant Peripheral blood was collected from the Llamas by venipuncture in citrate anti-coagulation sample tubes at the indicated time points after the $2^{nd}$, $3^{rd}$, $4^{th}$, and $5^{th}$ immunization (Table 1).

The homologues and heterologous immune response in each animal was analyzed by comparing the antigen specific serum titers of a sample collected prior to immunization (day 0) and a serum sample collected after antigen administrations (day 28 and day 112) in an HA ELISA. To this end, recombinant HA protein was captured in a Maxisorp 96-well microtiter plates. After blocking, serial dilutions of serum samples were added, and bound llama IgG was detected by addition of goat anti-llama IgG-HRP. Results are shown in FIG. 1. These data show that all immunized animals generated a good homologous and heterologous immune response against HA.

Example 2: Phage Library Construction

Peripheral Blood Mononuclear Cells (PBMC) were isolated from fresh blood using Ficoll-Paque plus (GE Healthcare) according to manufacturer's instructions. Total RNA extracted from PBMC served as starting material for RT-PCR to amplify the VHH encoding gene fragments. These fragments were cloned via SfiI and NotI restriction sites into M13 phagemid vector pDV-LucStuffer (pDV-006 derived; as described in WO 02/103012) to create a fusion of VHH domain with the pIII protein of the M13 phage (including an AMBER stop codon between the two proteins). Ligated vectors were transformed into TG-1 bacteria (Agilent) and 100-150 single colonies where analysed via PCR to determine the quality of each library. Insert frequency and completeness were typically more than 95%. The characteristics of the constructed libraries are shown in Table 2. Phage libraries from individual animals were prepared by using CT helper phages essentially as described (WO 02/103012), sterile filtered, and used for selections. As shown herein, complex phage libraries could be generated from all immunized llamas.

TABLE 2

Characteristics of VHH phage libraries.

| | # clones | # intact ORF | % intact ORF | of which % unique | CDR3 length amino acids | Complexity Cfu |
|---|---|---|---|---|---|---|
| L01 | 104 | 100 | 96 | 98 | 5-21 AA | 6.8E+06 |
| L02 | 117 | 114 | 97 | 95 | 5-27 AA | 1.4E+07 |
| L03 | 111 | 109 | 98 | 98 | 6-28 AA | 1.7E+07 |
| L04 | 111 | 109 | 98 | 96 | 5-23 AA | 1.6E+07 |

Example 3: Selections of Single Domain Antibodies Against Influenza HA

Antibody fragments were selected using the VHH phage display libraries described above and general phage display technology and MABSTRACT® technology essentially as described in U.S. Pat. No. 6,265,150, in WO 98/15833, and in "Phage display, A Laboratory Manual" by T. Kuhlman, 2001 (which are incorporated by reference herein). Furthermore, the methods and helper phages as described in WO 02/103012 (which is incorporated by reference herein) were used in the present invention.

Selections of specific binders were performed with hemagglutinin (HA) of influenza A (H1 A/California/07/2009, H1 A/New Caledonia/20/1999, H2 A/Japan/305/1957, H3 A/Brisbane/10/2007, H7 A/Netherlands/219/2003) and/or influenza B (Victoria clade B/Brisbane/60/2008, Yamagata clade B/Florida/04/2006) as target protein. The target protein source was either insect cell produced recombinant protein (Protein Sciences, Connecticut, USA) or HA expressed on the surface of influenza infected and fixed (3% paraformaldehyde) MDCK cells. Various selection conditions were used and are summarized in Table 3. "SD" refers to single domain antibody. If not mentioned otherwise, selections were performed at pH 7.4 and with 5 µg/ml HA protein. CR8033 and CR8071 are monoclonal antibodies (IgG) binding to the head and neck of influenza B HA (Dreyfus et al. 2012).

TABLE 3

Phage display selection conditions

| Single domain | Library | Selection 1 | Selection 2 | Selection 3 |
|---|---|---|---|---|
| SD1014 | L03 | H1 A/New Cal/20/99 | H7 A/Neth/219/03, pH5 | |
| SD1016 | L04 | H1 A/New Cal/20/99, 10 µg/mL | H7 A/Neth/219/03, 2 µg/mL | |
| SD1017 | L03 | H1 A/New Cal/20/99, 10 µg/mL | H5 A/Vietnam/1203/04, 2 µg/mL | |
| SD1018 | L03 | H1 A/New Cal/20/99, 10 µg/mL | H7 A/Neth/219/03 | |
| SD1025 | L03 | H1 A/New Cal/20/99 | H7 A/Neth/219/03, pH5 | |
| SD1027 | L04 | H1 A/New Cal/20/99 | H7 A/Neth/219/03, pH5 | |
| SD1034 | L04 | H3 A/Brisbane/10/07 | H1 A/New Cal/20/99, pH5 | |
| SD1035 | L03 | H3 A/Brisbane/10/07 | H1 A/New Cal/20/99, pH5 | |
| SD1036 | L03 | H3 A/Brisbane/10/07 | H1 A/New Cal/20/99, pH5 | |
| SD1038 | L04 | H3 A/Brisbane/10/07 | H1 A/New Cal/20/99, pH5 | |
| SD1045 | L01 | H1 A/New Cal/20/99, | H3 A/Brisbane/10/07, pH5 | |
| SD1046 | L01 | H3 A/Brisbane/10/07 | H1 A/California/07/09, pH5 | |
| SD1047 | L01 | H3 A/Brisbane/10/07 | H1 A/California/07/09, pH5 | |
| SD1048 | L02 | H3 A/Brisbane/10/07 | H1 A/California/07/09, pH5 | |
| SD1049 | L02 | H3 A/Brisbane/10/07 | H1 A/California/07/09, pH5 | |
| SD1069 | L03 | H7 A/Netherl/219/03 | H2 A/Japan/305/57, pH5 | |
| SD1070 | L03 | H7 A/Netherl/219/03 | H2 A/Japan/305/57, pH5 | |
| SD1071 | L04 | H5 A/Vietnam/1203/04 | H3 A/Uruguay/716/07, pH5 | |
| SD1072 | L04 | H7 A/Netherl/219/03 | H2 A/Japan/305/57, 5 µg/mL, pH5 | |
| SD1073 | L04 | H7 A/Netherl/219/03 | H2 A/Japan/305/57, pH5 | |
| SD1074 | L04 | H7 A/Netherl/219/03 | H2 A/Japan/305/57, pH5 | |
| SD1076 | L07 | H7 A/Netherl/219/03 | H2 A/Japan/305/1957, pH5 | |
| SD1083 | L03 | B/Brisbane/60/08 | B/Florida/04/06 block with CR8033 and CR8071 | |
| SD1084 | L03 | B/Brisbane/60/08 | B/Florida/04/06 block with CR8033 and CR8071 | |

TABLE 3-continued

Phage display selection conditions

| Single domain | Library | Selection 1 | Selection 2 | Selection 3 |
|---|---|---|---|---|
| SD1085 | L04 | B/Brisbane/60/08 | B/Florida/04/06 | |
| SD1086 | L04 | B/Brisbane/60/08 | B/Florida/04/06 | |
| SD1087 | L04 | B/Brisbane/60/08 | B/Florida/04/06 | |
| SD2020 | L03 | MDCK infected with H3 A/Wisconsin/67/05 | H3 A/Brisbane/10/07 block with CR8057 | |
| SD2086 | L03 | B/Brisbane/60/08 | B/Florida/04/06 block with CR8033 and CR8071 | H3 A/Brisbane/10/07 block with CR8057 |

For first round selections immunotubes were coated overnight with HA (5.0 μg/mL diluted in PBS) and washed with block buffer (2% non-fat dry milk (ELK) in PBS). Aliquots (5-10 μL) of the phage display libraries were blocked in 2 mL blocking buffer (5% non-heat inactivated fetal bovine serum (FBS), 1% mouse serum, and 2% ELK in PBS) and added to the immunotubes. After 2 h incubation at room temperature (RT) tubes were washed (5 to 15 times with 0.05% Tween-20 in PBS and 3 to 5 times with PBS). Bound phages were eluted for 10 min with triethylamine (100 mM) and the pH adjusted to 7.5. E. coli XL1-Blue were infected with eluted phages, plated, and incubation over night at 37° C. Colonies were counted (between 1E+04 and 1E+06 CFU) and scraped from the plates to prepare an enriched phage library (as described in WO 02/103012).

Second round selections were carried out using the phages rescued from the first round and followed essentially the same protocol with the exception of altered antigens, pH and or the addition of epitope blocking monoclonal antibodies. Variant panning strategies were applied with the aim to select strong binders specifically targeting the conserved stem region of HA. To select for cross-reactive single domain clones, also lower amounts of different HA antigens, compared to the first round selection were used. A low pH wash step was introduced in the protocol to increase the chance for selecting phages that can bind to the stem and block the conformational change of HA occurring at pH 5.0 (Brandenburg et al. 2013). Hereto the HA coated immunotubes were incubated for 10 min with 5 times diluted Tryple Select (recombinant trypsin; Invitrogen) to cleave the coated $HA_0$ (into $HA_1$-$HA_2$) followed by washing and blocking steps. After incubation with the phages, the tubes were washed as described earlier, followed by 20 minutes incubation in citric acid sodium phosphate buffer at pH 5.1. After three PBS wash steps phage elution continued as described above. The addition of IgG1 antibodies (10 μg/mL) during selections blocks immune dominant epitopes at the head or neck of HA and can also increases the chance for selecting single domain phages binding to stem of HA. Antibodies CR8033 and CR8071 (Dreyfus et al. 2012) were added during blocking of HA coated immunotubes and during incubation with the phage libraries.

Two or three consecutive rounds of selections were performed before isolation of individual sdAbs. Each selection output was sequence analysed for enrichment factor and the best selections were chosen for further analysis. Individual E. coli colonies were picked to prepare periplasmic extracts containing crude monoclonal sdAbs. In brief, eluted phages were used to infect E. coli strain SF110' cultures (2YT medium, 10 μg/mL tetracycline, 4% glucose), individual colonies where picked and grown in 96 deep well plates (1 mL 2YT-ATG medium). VHH domain expression was induced by adding IPTG (1 mM). Periplasmic extracts were prepared by dissolving bacteria pellets in 150 μL TES-buffer (100 mM Tris-HCl, 1 mM EDTA, 500 mM sucrose, pH 8.0) for 30 min on ice. The osmotic shock releases the periplasmic fraction and the cleared and sterile filtered sdAb containing supernatant was used for functional screening (see Example 4).

SdAbs from small scale productions (1 mL in 96 deep well plates) were purified and concentrated by using Ni-NTA 96-well spin plates according to manufacturer's instructions.

In parallel to periplasmic extract generations the remaining culture of individual clones were used to create glycerol stocks and to isolate plasmid DNA for sequencing of VHH genes. Unique sequences were further tested.

Cross-selections using HA proteins from influenza group 1, group 2 or B, as well as stringent wash steps at low pH allowed for the isolation of broadly HA binding phages. Periplasmic extractions of small scale E. coli productions resulted in reproducible protein levels suitable for functional screening.

Example 4: Functional Screening for Influenza Virus Neutralizing Single Domain Antibodies SdAb containing periplasmic extracts were analyzed in a virus neutralization assay (VNA) for their ability to prevent influenza virus infection of mammalian cells. For this purpose, MDCK cells (ATCC, cat # CCL-34) were seeded in 96-well plates (4E+04 cells/well) and 4h later incubated with a mixture of influenza virus (100 TCID50/well) and sterile filtered periplasmic extract (15 μL/well or dilutions thereof). After 3 days of incubation at 37° C. and 10% $CO_2$, the amount of newly produced virus in the cell culture supernatant was assessed by hemagglutination of 1% turkey red blood cells (TRBC) in V-bottom plates (neutralizing sdAbs reduce viral load in the supernatant resulting in prevention of hemagglutination of TRBC). Since the sdAb input concentration is unknown for the periplasmic extracts, samples were only scored positive or negative for viral neutralization. Multiple influenza strains were tested in parallel to select preferably broad neutralizing sdAbs (see Table 3a).

In conclusion, functional screening resulted in sdAbs which can be classified as neutralizing A group 1, A group 2, A group 1 and 2, or influenza B viruses.

TABLE 3a

Functional screening for influenza neutralizing single domain antibodies ('+' represents neutralization, '−' represents no neutralization, A g1 refers to influenza A group 1, A g2 refers to influenza A group 2. B refers to influenza B; empty cells mean 'not tested')

| | | A/New Caledonia/ 20/99 | A/ Puerto Rico/ 8/34-MA | A/PR8 H5N1 HK97 | A/ Vietnam/ 1194/04 | A/ Brisbane/ 10/2007 | A/HK/1/ 68-MA | A/ NIBRG/ 60 (A/ mallard/ NL/ 12/00) | B/ Brisbane/ 60/ 08 | B/ Florida/ 04/ 06 | B/ Lee/ 40 |
| | Single | A group 1 | | | | A group 2 | | | | | |
| Class | domain | H1N1 | H1N1 | H5N1 | H5N1 | H3N2 | H3N2 | H7N3 | B | | |
|---|---|---|---|---|---|---|---|---|---|---|---|
| A g1 | SD1016 | + | + | + | + | − | − | − | − | − | − |
| A g1 | SD1018 | + | | | + | − | − | | | | |
| A g1 | SD1027 | + | | | + | − | | − | | | |
| A g1 | SD1071 | + | | | + | − | | − | | | |
| A g1 | SD1072 | + | | | + | − | | − | | | |
| A g1 | SD1074 | + | | | + | − | − | | | − | − |
| A g1 | SD1076 | + | + | + | + | − | − | − | | | |
| A g1 | SD1034 | + | + | | + | − | − | − | | − | − |
| A g1 | SD1035 | + | | | − | − | | − | | | |
| A g2 | SD1014 | − | − | | − | + | − | + | | | |
| A g2 | SD1017 | − | − | | − | − | + | + | | | |
| A g2 | SD1025 | − | − | − | − | + | − | + | − | − | − |
| A g2 | SD1036 | − | − | − | − | + | + | + | − | − | − |
| A g2 | SD1046 | − | − | − | − | + | + | + | − | − | − |
| A g2 | SD1047 | − | − | − | − | − | − | + | | | |
| A g2 | SD1048 | − | − | − | − | + | + | + | − | − | − |
| A g2 | SD1049 | − | − | − | − | + | + | + | − | − | − |
| A g2 | SD1070 | − | − | − | − | + | − | + | | | |
| A g2 | SD2020 | | | | − | + | − | | | | |
| A g1 + g2 | SD1038 | + | + | + | + | + | + | + | − | − | − |
| A g1 + g2 | SD1045 | + | + | + | + | + | − | − | − | − | − |
| A g1 + g2 | SD1069 | + | + | + | + | − | − | + | | | |
| A g1 + g2 | SD1073 | + | + | + | + | − | − | + | | | |
| B | SD1083 | − | − | − | − | − | − | − | + | + | + |
| B | SD1084 | − | − | − | − | − | − | − | + | + | − |
| B | SD1085 | − | − | − | − | − | − | − | + | + | − |
| B | SD1086 | − | | | − | | | | + | − | + |
| B | SD1087 | − | | | − | | | | + | − | + |
| B | SD2086 | − | | | − | | | | − | − | + |

Example 5: Single Domain Antibody Expression and Purification

Relevant sdAb sequences were cloned into a standard eukaryotic expression vector suitable for use in Expi293 suspension cells. Production runs were performed for 5-6 days. Expressed sdAbs are secreted in cell culture media. Before complete depletion of glucose from the medium, the culture supernatant was harvested, centrifuged, and sterile filtered. SdAbs were purified using an anti-His resin containing nickel ions (cOmplete HIS-Tag column; Roche, cat #06781543001) and eluted using a high concentration of Imidazole (300 mM). The eluate was buffer exchanged to its final formulation buffer (20 mM NaAc, 75 mM NaCl, 5% Sucrose pH5.5) using a desalting column (HiPrep 26/10 desalting column, GEHC cat #17-5087) and concentrated using Amicon Ultra 3K spin filter (Millipore, cat # UFC900324). After concentration determination, pure sdAbs aliquots were further characterization by SDS-PAGE, HPSEC, SEC-MALS and endotoxin determination. A minimum yield of 5 mg of purified sdAb out of a transfection volume of 600 mL was obtained for all constructs. Only sdAb batches with more than 95% monomeric content and correct molecular mass where used for further characterization.

For selected applications sdAbs without tags (e.g. HIS-tag) were desired. Non-tagged sdAbs were purified via multi-step Ion Exchange Chromatography (IEX). The cleared and filtered supernatant was diluted two-fold in dH$_2$O to lower the conductivity, the pH set to 8.0, and the sample was loaded onto a positively charged Capto Q Impress resin (GEHC, cat #17-5470-02). Non-charged sdAbs remained in the flow through which was then adjusted to pH 3.5. Now positively charged sdAbs were captured on a negatively charged HiTrap Capto SP ImpRes column (GEHC, cat #17-5468-55) and eluted using a high concentration of sodium chloride. The pI of a sdAb can vary greatly and this method was used for molecules with a negative to +1.0 charge at pH 8 and at least a charge of more than +10 in the range of pH 3 to 5. Eluted sdAbs were further treated as described above.

As shown herein, Expi293 cell expression and purification strategies based on HIS-tag and on ion-exchange for tag-less constructs yielded high quantity and quality of monomeric sdAb constructs.

Example 6: Characterization of Single Domain Antibodies

Breadth of Influenza Virus Neutralization

Neutralizing titers of purified sdAbs were assessed by testing a range of concentrations on a large panel of influenza virus strains using the virus neutralization assay as described in Example 4. Titers are reported in Table 4-7. Based on their activity, sdAbs can be divided in influenza A group 1 (encompassing of H1, H5, H2, H6, H11, H9, H8, and H12 viruses) neutralizing molecules, influenza A group 2 (encompassing of H3, H4, H14, H7, and H10 viruses) neutralizing molecules, and influenza B (encompassing Yamagata, Victoria, and Predecessor/Old viruses) neutralizing molecules. Interestingly, some of the sdAbs were capable of neutralizing influenza A viruses from both group 1 and group 2 (Table 6).

TABLE 4

Average neutralization titers (nM) for A group 1 class single domain antibodies (empty cells mean 'not tested').

| Subtype | Influenza virus strain | SD1016 | SD1018 | SD1027 | SD1034 | SD1035 | SD1071 | SD1072 | SD1074 | SD1076 |
|---|---|---|---|---|---|---|---|---|---|---|
| H1N1 | A/California/07/09 | 9.1 | | | | | | | | 3.1 |
| | A/New Caledonia/20/99 | 7.1 | >1000 | 862.0 | 160.6 | 74.8 | 1256.4 | 78.5 | 112.9 | 22.1 |
| | A/Puerto Rico/8/34-MA | 15.7 | | | 756.1 | | | | | 8.7 |
| H5N1 | A/PR8 H5N1 HK97 | 27.8 | | | | | | | | 66.8 |
| | A/Vietnam/1194A)4 | 29.3 | 614.6 | >1000 | 721.5 | >1000 | 111.1 | 443.9 | 638.4 | 84.7 |
| H2N2 | A/Guiyang/1/57 | | | | | | | | | >1000 |
| | A/WF/HK/MPU3156/05 | | | | | | | | | 38.5 |
| H3N2 | A/Brisbane/10/07 | >1000 | >1000 | >1000 | >1000 | >1000 | >1000 | >1000 | >1000 | >1000 |
| | A/HK/1/68-MA | >1000 | | | >1000 | | | | | >1000 |
| | A/Panama/2007/99 | >1000 | | | | | | | | |
| | A/Wisconsin/67/05 | >1000 | | | | | | | | >1000 |
| H4 | A/WF/HK/MPA892/06 | >1000 | | | | | | | | >1000 |
| H7N3 | A/NIBRG/60 (A/mallard/NL/12/00) | >1000 | >1000 | >1000 | >1000 | >1000 | >1000 | >1000 | >1000 | >1000 |
| H7N7 | A/PR8 H7N7-NY | >1000 | | | | | | | | |
| H10N7 | A/Chick/Germany/N/49 | >1000 | | | | | | | | >1000 |
| Victoria | B/Brisbane/60/08 | >1000 | | | | | | | | |
| Yamagata | B/Florida/04/06 | >1000 | | | | | | | | |

TABLE 5

Average neutralization titers (nM) for A group 2 class single domain antibodies (empty cells mean 'not tested').

| Subtype | Influenza virus strain | SD1014 | SD1017 | SD1025 | SD1036 | SD1046 | SD1047 | SD1048 | SD1049 | SD1070 | SD2020 |
|---|---|---|---|---|---|---|---|---|---|---|---|
| H1N1 | A/California/07/09 | >1000 | >1000 | | >1000 | >1000 | | >1000 | >1000 | >1000 | |
| | A/New Caledonia/20/99 | >1000 | >1000 | >1000 | >1000 | >1000 | | >1000 | >1000 | >1000 | |
| | A/Puerto Rico/8/34-MA | >1000 | >1000 | >1000 | >1000 | >1000 | >1000 | >1000 | >1000 | >1000 | |
| | A/Brisbane/59/07 | >1000 | >1000 | >1000 | >1000 | >1000 | | >1000 | >1000 | >1000 | |
| | A/Mississippi/03/01 274H | | | | >1000 | | | | | | |
| | A/Solomon Islands/3/2006 (IVR 145) | | | | >1000 | | | | | | |
| | A/WSN/33 | | | | >1000 | | | | | | |
| | A/HK/54/98 | | | | >1000 | | | | | | |
| | A/Christchurch/16/10 | | | | >1000 | | | | | | |
| H1N2 | A/Em/HK/MPU3156/05 | | | | >1000 | | | | | | |
| H5N1 | A/PR8 H5N1 I IK97 | | | | >1000 | >1000 | | >1000 | | | |
| | A/Vietnam/1194/04 | >1000 | >1000 | >1000 | >1000 | >1000 | >1000 | >1000 | >1000 | >1000 | >1000 |
| | A/lndonesia/5/05 | | | | >1000 | | | | | | |
| H5N2 | A/Eurasian Wigeon/MPF461/07 | | | | | | | | | | |
| | A/Eurasian Wigeon/HK/MPF333/07 | | | | >1000 | | | | | | |
| H2N2 | A/Guiyang/1/57 | | | | >1000 | | | | | | |
| | A/AnnArbor/23/57 | | | | >1000 | | | | | | |
| | A/Env/HK/MPU3156/05 | | | | >1000 | | | | | | |
| H6N1 | A/Eurasian Wigeon/MPG1884/09 | | | | >1000 | | | | | | |
| | A/Taiwan/2/2013 | | | | >1000 | | | | | | |
| H6N8 | A/Eurasian Wigeon/MPD411/07 | | | | >1000 | | | | | | |
| H11N9 | A/Northern Pintail/MPC2085/07 | | | | >1000 | | | | | | |
| H9N2 | A/Ck/HK/SSP176/09 | | | | >1000 | | | | | | |
| | A/Great Cormorant/MP2934/04 | | | | 677.4 | | | | | | |
| | A/HK/466419/09 | | | | >1000 | | | | | | |
| H8N4 | A Eurasian Wigeon/MPH571/08 | | | | >1000 | | | | | | |
| H8N2 | A/Env/MPJ1258/09 | | | | >1000 | | | | | | |
| H12N5 | A/Env/MPK659/09 | | | | >1000 | | | | | | |
| H3N2 | A/Brisbane/10/07 | >1000 | >1000 | >1000 | 86.7 | 6.6 | | 19.5 | 19.1 | 15.3 | 9.3 |
| | A/HK/1/68 | | | | 114.6 | 202.0 | | | | | |
| | A/HK/1/68 (D375N, 1395V) | | | | >1000 | >1000 | | | | | |
| | A/HK/1/68 (E443K) | | | | >1000 | 202.0 | | | | | |

TABLE 5-continued

Average neutralization titers (nM) for A group 2 class single domain antibodies (empty cells mean 'not tested').

| Subtype | Influenza virus strain | SD1014 | SD1017 | SD1025 | SD1036 | SD1046 | SD1047 | SD1048 | SD1049 | SD1070 | SD2020 |
|---|---|---|---|---|---|---|---|---|---|---|---|
| | A/HK/1/68 (G379R) | | | | >1000 | 570.7 | | | | | |
| | A/HK/1/68 (I395V) | | | | >1000 | >1000 | | | | | |
| | A/HK/1/68 (L331I, E443K) | | | | >1000 | 202.0 | | | | | |
| | A/HK/1/68 (N8S, E443K) | | | | >1000 | 202.0 | | | | | |
| | A/HK/1/68 (R201G, L331I, E443K) | | | | >1000 | 339.3 | | | | | |
| | A/HK/1/68-MA | >1000 | >1000 | >1000 | 73.2 | 26.4 | >1000 | 110.4 | 76.1 | | |
| | A/Panama/2007/99 | | | | >1000 | >1000 | | >1000 | | | |
| | A/Wisconsin/67/05 | >1000 | >1000 | | >1000 | >1000 | | >1000 | >1000 | >1000 | 304.0 |
| | A/Fukui/45/04 | | | | >1000 | | | | | | |
| | A/Aichi/2/68 | | | | 6.5 | | | | | | |
| | A/Hiroshima/52/05 | | | | >1000 | | | | | | |
| | A/Johannesburg/33/94 | | | | 600.6 | | | | | | |
| | A/Perth/16/09 | | | | 76.4 | | | | | | |
| | A/Victoria/210/09 | | | | 540.2 | | | | | | |
| | A/HK/1174/99 | | | | >1000 | | | | | | |
| H3N? | A/Env/MPJ193/09 | | | | 41.0 | | | | | | |
| H4 | A/WF/HK/MPA892/06 | | | | 40.4 | 34.3 | | 34.3 | | | |
| H4N1 | A/Northern Pintail/MPB1368/06 | | | | 80.7 | | | | | | |
| H4N6 | A/Great Cormorant/MPB1683/06 | | | | 44.5 | | | | | | |
| H14N5 | A/Mallard/Astrakhan/263/1982 | | | | 16.2 | | | | | | |
| H7N3 | A/NIBRG/60 (A/mallard/NL/12/00) | 136.8 | 34.7 | 52.0 | 10.9 | 26.4 | 509.7 | 20.6 | 114.6 | 366.2 | >1000 |
| H7N7 | A/PR8 H7N7-NY | | | | 8.8 | 25.9 | | 93.0 | | | |
| | A/Northern Shoveler/MPF518/08 | | | | 44.7 | | | | | | |
| | A/Netherlands/219/2003 | | | | 28.9 | | | | | | |
| | A/Common Teal/MPFl39/07 | | | | 18.3 | | | | | | |
| H7N9 | A/Anhui/1/13 | | | | 65.9 | 46.1 | | | | | |
| | A/Shanghai/1/13 | | | | 101.2 | | | | | | |
| | A/Shanghai/2/13 | | | | 33.0 | | | | | | |
| H10N7 | A/Chick/Germany/N/49 | | | | 22.2 | 34.3 | | 34.3 | | | |
| H10N8 | A/Jiangxi/346/2013 | | | | 83.9 | | | | | | |
| H10N3 | A/Common Teal/MPHl1/08 | | | | 28.9 | | | | | | |
| H10N9 | A/Northern Shoveler/MPE2531/08 | | | | 19.9 | | | | | | |
| Victoria | B/Brisbane/60/08 | | | | >1000 | >1000 | | >1000 | | | |
| Yamagata | B/Florida/04/06 | | | | >1000 | >1000 | | >1000 | | >1000 | |

TABLE 6

Average neutralization titers (nM) for A group 1 and 2 class single domain antibodies (empty cells mean 'not tested')

| Subtype | Sample | SD1038 | SD1045 | SD1069 | SD1073 |
|---|---|---|---|---|---|
| H1N1 | A/California/07/09 | 17.5 | 85.9 | 3.3 | 30.3 |
| | A/New Caledonia/20/99 | 10.1 | 165.6 | 20.8 | 98.9 |
| | A/Puerto Rico/8/34-MA | 8.8 | 206.4 | 12.8 | 89.6 |
| | A/Brisbane/59/07 | 3.1 | | | |
| | A/Mississippi/03/01 274H | 4.7 | | | |
| | A/Solomon Islands/3/2006 (IVR 145) | 4.1 | | | |
| | A/WSN/33 | 5.0 | | | |
| | A/HK/54/98 | 16.5 | | | |
| | A/Christchurch/16/10 | 2.6 | | | |
| H1N2 | A/Env/BK/MPU3156/05 | 40.5 | | | |
| H5N1 | A/PR8 H5N1 HK97 | 9.7 | 117.2 | 241.7 | 179.1 |
| | A/Vietnam/1194/04 | 30.1 | 63.5 | 74.0 | 223.9 |
| | A/Indonesia/5/05 | 32.8 | | | |
| H5N2 | A/Eurasian Wigeon/MPF461/07 | 18.8 | | | |
| | A/Eurasian Wigeon/BK/MPF333/07 | 11.0 | | | |
| H2N2 | A/Guiyang/1/57 | 101.7 | | | |
| | A/WF/HK/MPU3156/05 | 31.4 | | | |
| | A/AnnArbor/23/57 | 33.0 | | | |
| | A/Env/HK/MPU3156/05 | 23.2 | | | |
| H6N1 | A/Eurasian Wigeon/MPG1884/09 | 16.2 | | | |
| | A/Taiwan/2/2013 | 15.3 | | | |
| H6N8 | A/Eurasian Wigeon/MPD411/07 | 13.2 | | | |
| H11N9 | A/Northern Pintail/MPC2085/07 | 160.0 | | | |
| H9N2 | A/Ck/HK/SSP176/09 | 90.8 | | | |
| | A/Great Cormorant/MP2934/04 | 104.6 | | | |
| | A/HK/466419/09 | 700.0 | | | |
| H8N4 | A/Eurasian Wigeon/MPH571/08 | 53.4 | | | |
| H8N2 | A/Env/MPJ1258/09 | 58.7 | | | |
| H12N5 | A/Env/MPK659/09 | >1000 | | | |
| H3N2 | A/Brisbane/10/07 | 19.0 | 640.9 | >1000 | >1000 |
| | A/HK/1/68 | 40.2 | >1000 | >1000 | >1000 |
| | A/Fukui/45/04 | 632.5 | | | |
| | A/Aichi/2/68 | 127.2 | | | |
| | A/Johannesburg/33/94 | 442.7 | | | |
| | A/Perth/16/09 | 253.0 | | | |
| | A/Victoria/210/09 | 253.0 | | | |
| H3N? | A/Env/MPJ193/09 | 185.4 | | | |
| H4 | A/WF/HK/MPA892/06 | >1000 | 492.4 | >1000 | >1000 |

TABLE 6-continued

Average neutralization titers (nM) for A group 1 and 2 class single domain antibodies (empty cells mean 'not tested')

| Subtype | Sample | SD1038 | SD1045 | SD1069 | SD1073 |
|---|---|---|---|---|---|
| H4N1 | A/Northern Pintail/MPB1368/06 | 484.7 | | | |
| H4N6 | A/Great Cormorant/MPB1683/06 | 275.2 | | | |
| H14N5 | A/Mallard/Astrakhan/263/1982 | 253.0 | | | |
| H7N3 | A/NMRG/60 (A/mallard/NL/12/00) | >1000 | >1000 | >1000 | 135.1 |
| H7N7 | A/PR8 H7N7-NY | 80.6 | >1000 | | |
| | A/Northern Shoveler/MPF518/08 | 441.4 | | | |
| | A/Netherlands/219/2003 | 180.6 | | | |
| | A/Common Teal/MPF139/07 | 359.1 | | | |
| H7N9 | A/Anhui/1/13 | 253.0 | | | |
| | A/Shanghai/1/13 | 503.0 | | | |
| | A/Shanghai/2/13 | 239.1 | | | |
| H10N7 | A/Chick/Germany/N/49 | 468.6 | 984.7 | >1000 | 316.6 |
| H10N8 | A/Jiangxi/346/2013 | 239.1 | | | |
| H10N3 | A/Common Teal/MPH11/08 | 300.6 | | | |
| H10N9 | A/Northern Shoveler/MPE2531/08 | 327.0 | | | |
| Victoria | B/Brisbane/60/08 | >1000 | >1000 | | |
| Yamagata | B/Florida/04/06 | >1000 | >1000 | | |

TABLE 7

Average neutralization titers (nM) for B class single domain antibodies (empty cells mean 'not tested').

| Subtype | Sample | SD1083 | SD1084 | SD1085 | SD1086 | SD1087 | SD2086 |
|---|---|---|---|---|---|---|---|
| Victoria | B/Brisbane/60/08 | 178.5 | 20.5 | 40.7 | 826.6 | 10.2 | 934.2 |
| | B/Malaysia/2506/04 | 293.8 | 34.9 | 66.3 | >1000 | 79.1 | 546.1 |
| Yamagata | B/Florida/04/06 | 219.7 | 68.8 | 186.9 | >1000 | >1000 | 814.7 |
| | B/Harbin/7/94 | 258.9 | 240.0 | 631.2 | >1000 | 503.0 | 963.8 |
| | B/Massachusetts/02/12 | | 40.0 | | | | |
| Old | B/Lee/40 | 216.7 | >1000 | | | 6.5 | 273.1 |

Breadth of Binding to HA

The biolayer interferometry platform Octet Red384 (Forté Bio, Pall) was used for label free real time binding analysis of protein—protein interactions in a fast dip and read method on the surface of specific sensors. The shift in detected mass at the tip of a functionalized sensor allowed for studying the binding of sdAbs to recombinant HA. When done over a range of concentrations, not only a general binding but also the $K_D$ of sdAbs was determined.

Purified sdAbs with a C-terminal HIS tag were capture on an anti-His sensor (loading phase, Anti-Penta-His sensors, Forté Bio, cat #18-0020). Subsequently the sdAb loaded sensors was incubated with different HA subtypes (20 µg/mL) to test for binding (association phase). The last step of the assay is incubating the sensors in kinetic buffer to determine the dissociation rate of the HA-sdAb complex. Binding capabilities of tested sdAbs are listed in Table 8. Often, sdAbs bind HAs of more strains than they are able to neutralize. The broader binding spectrum is related to their individual affinity for HA (see also Table 9 with $K_D$ values).

TABLE 8

Label free detection of sdAb binding to HA ( '+' represents binding to HA, '−' represents no binding, A g1 refers to influenza A group 1, A g2 refers to influenza A group2, B refers to influenza B; empty cells mean 'not tested').

| Class | Single domain | A/New Caledonia/20/99 H1N1 | A/Puerto Rico/8/34-MA H1N1 | A/Brisbane 59/07 H1N1 | A/PR8 H5N1 HK97 H5N1 | A/Vietnam 1194/04 H5N1 | A/Brisbane 10/07 H3N2 | A/HK 1/68 H3N2 | A/Wisconsin 67/05 H3N2 | A/NIBRG/60/(A/mallard/NL/12/00) H7N3 | B/Brisbane 60/08 B | B/Florida 04/06 B | B/Lee/40 B |
|---|---|---|---|---|---|---|---|---|---|---|---|---|---|
| | | A group 1 | | | | | A group 2 | | | | | | |
| A g1 | SD1016 | + | + | + | + | + | − | − | − | − | − | − | |
| A g1 | SD1018 | + | | | | + | | | | | | | |
| A g1 | SD1071 | + | | | | + | − | | | − | − | − | − |

TABLE 8-continued

Label free detection of sdAb binding to HA ('+' represents binding to HA, '−' represents no binding, A g1 refers to influenza A group 1, A g2 refers to influenza A group2, B refers to influenza B; empty cells mean 'not tested').

| Class | Single domain | A/New Caledonia/ 20/99 H1N1 | A/Puerto Rico/8/ 34-MA H1N1 | A/Brisbane 59/07 H1N1 | A/PR8 H5N1 HK97 H5N1 | A/Vietnam 1194/ 04 H5N1 | A/Brisbane 10/07 H3N2 | A/HK 1/68 H3N2 | A/Wisconsin 67/05 H3N2 | A/NIBRG/ 60/(A/ mallard/ NL/ 12/00) H7N3 | B/ Brisbane/ 60/08 B | B/ Florida/ 04/06 | B/ Lee/ 40 |
|---|---|---|---|---|---|---|---|---|---|---|---|---|---|
| A g1 | SD1072 | + | | | | + | − | | | − | − | − | − |
| A g1 | SD1074 | + | | | | + | − | | | − | − | − | − |
| A g1 | SD1076 | + | + | + | + | + | − | − | − | − | − | − | − |
| A g1 | SD1035 | + | | + | | | | − | | − | − | − | − |
| A g2 | SD1017 | − | | − | | | − | + | + | + | − | − | |
| A g2 | SD1025 | | | | | | | + | | + | | − | |
| A g2 | SD1070 | | | | | − | | + | | + | − | − | |
| A g2 | SD2020 | | | | | | | + | | | | | |
| A g1 + g2 | SD1014 | + | | − | | + | + | + | − | + | − | − | |
| A g1 + g2 | SD1027 | + | | | | + | + | | | + | − | | |
| A g1 + g2 | SD1034 | + | + | + | | + | + | + | | − | − | − | |
| A g1 + g2 | SD1036 | + | | − | | + | + | + | | + | − | − | |
| A g1 + g2 | SD1038 | + | + | + | + | + | + | + | | + | − | − | |
| A g1 + g2 | SD1045 | + | + | + | + | + | + | − | | − | − | − | |
| A g1 + g2 | SD1046 | + | | + | | + | + | + | | + | − | − | |
| A g1 + g2 | SD1047 | + | | | | + | | + | | + | − | − | |
| A g1 + g2 | SD1048 | + | − | | | + | + | + | | + | − | − | |
| A g1 + g2 | SD1049 | + | − | | | + | + | + | − | + | − | − | |
| A g1 + g2 | SD1069 | + | + | + | + | + | + | | − | + | − | − | |
| A g1 + g2 | SD1073 | + | + | | + | + | − | | | + | − | − | |
| B | SD1083 | − | | | | | − | | | | | + | + | + |
| B | SD1084 | − | | | | | − | | | | | + | + | |
| B | SD1085 | − | | | | | − | | | | | + | + | |
| B | SD1086 | − | | | | | − | | | | | + | + | + |
| B | SD1087 | − | | | | | − | | | | | + | + | + |

Label free biolayer interferometry was also used to determine the equilibrium dissociation constants ($K_D$ values) as measure of the binding potencies between the sdAbs and recombinant HA molecules of different Influenza strains. The $K_D$ values were determined by fitting the binding responses of a sdAb concentration range at steady state (average binding response of the last 10 seconds measured at the plateau in association phase) to obtain the concentration at 50% of the saturation, which reflects the $K_D$ value ($R=R_{max}*[sdAb]/(K_D+[sdAb])$). Serial dilutions were measured in duplicate and geometric mean $K_D$ values are reported in Table 9.

Competition of Single Domain Antibodies with Other HA Binders

Binding competition studies were designed to screen sdAbs for competition amongst themselves and against other HA binding proteins, including well characterized monoclonal antibodies (IgG) with known epitopes on HA. If competition was observed it is assumed that both molecules bind to a similar or at least overlapping epitope at the surface of HA.

Hereto an AlphaLISA competition assay (Perkin Elmer) was established which relied on biotinylated HA (Protein Sciences, 10 μL, 0.5 nM final concentration in 50 μL) bound

TABLE 9

Affinity of selected sdAbs. Geometric mean $K_D$ values (nM) of sdAb binding to HA (empty cells mean 'not tested')

| | H1N1 A/New Caledonia/ 20/1999 | H1N1 A/ Brisbane 59/07 | H3N2 A/HK 1/68 | H3N2 A/ Wisconsin 67/05 | H3N2 A/ Brisbane 10/2007 | H7N3 A/ NIBRG/60/ (A/mallard/ NL/12/00) | H7N9 A/ Hangzhou/ 1/2013 | Victoria B/ Brisbane/ 60/08 |
|---|---|---|---|---|---|---|---|---|
| SD1036 | 230 | 290 | 2 | 122 | 10 | 2 | 3 | |
| SD1038 | 4 | 3 | 44 | 42 | 14 | 88 | 57 | |
| SD1016 | 6 | | | | | | | |
| SD1045 | 5 | | | | | | | |
| SD1046 | | | | | 2 | 3 | | |
| SD1048 | | | | | 3 | 3 | | |
| SD1083 | | | | | | | | 3 |
| SD1084 | | | | | | | | 109 | by IgGs or His-tagged sdAbs (Perkin Elmer, 10 µL, 0.3 nM final concentration in 50 µL). The interaction between HA and the binder was detected after 1h incubation at RT with two beads, a streptavidin donor bead recognizing HA (10 µL of 10 µg/mL) and an anti Fc or anti His acceptor bead (10 µg/mL) recognizing either the IgGs or sdAbs used. If after an additional hour of incubation the excited donor bead (680 nm) and acceptor bead are in close proximity, an energy transfer (singlet oxygen) can be measured as a luminescence signal of the acceptor bead. The signal intensity in this homogeneous assay format is directly proportional to the binding strength (affinity/avidity) between both binding partners. A competitor, depending on its affinity and concentration (usually tested in a range from 100 nM to 0.5 pM) can disrupt the AlphaLISA signal leading to a sigmoidal inhibitor curve which is fitted with a standard four parameter logistic nonlinear regression model in SPSS. Averages of calculated pIC50 values are shown in Table 10 and 11.

Table 10 and 11 show the average of AlphaLISA pIC50 values (negative log of half maximal inhibitory concentration, higher values indicate exponentially greater potency). 'H1_Cal_HA' refers to H1N1 A/California/07/2009, 'H1_NCa_HA' refers to HA of H1N1 A/New Caledonia/20/1999, 'H5_Vie_HA' refers to HA of H5N1 A/Vietnam/1203/2004, 'H3_Bri_HA' refers to HA of H3N2 A/Brisbane/10/2007, 'H3_Wis_HA' refers to HA of A/Wisconsin/67/2005, 'H7_Net_HA' refers to the HA of H7N7 A/Netherlands/219/2003; B_Bri_HA' refers to HA of B/Brisbane/60/2008; 'B_Flo_HA' refers to HA of B/Florida/04/2006 'CR8033', 'CR8071' and 'CR9114' are HA binding IgGs characterized by Dreyfus et al. 2012. '2D1' refers to an IgG binding to the receptor binding site of HA characterized by Xu et al. (2010). 'CR8020' is an IgG binding to the stem of HA characterized by Ekiert et al. (2011). '39.29' is an IgG binding to the stem of HA characterized in WO2014078268. All SDxxxx possess a His tag used for detection except for indicated 'tagless' versions. Empty cells mean 'not tested'.

TABLE 10

SdAb competition for binding to influenza A HA.

| | SD1014 | SD1016 | SD1036 | SD1038 | SD1046 | SD1083 | SD1084 | SD1087 |
|---|---|---|---|---|---|---|---|---|
| H1_Cal_HA_2D1 | | | <7 | <7 | <7 | | | <7 |
| H1_Cal_HA_CR9114 | <7 | 10.3 | <7 | 9.9 | <7 | | | <7 |
| H1_NCa_HA_CR9114 | <7 | 9.9 | <7 | 10.1 | | | | |
| H1_Cal_HA_SD1038 | | | <7 | 9.9 | | <7 | <7 | <7 |
| H5_Vie_HA_CR9114 | <7 | 9.6 | <7 | 9.3 | | | | |
| H3_Bri_HA_CR8020 | 7.2 | <7 | 9.2 | 7.8 | 9.6 | | | |
| H3_Bri_HA_CR8057 | <7 | <7 | <7 | <7 | | | | <7 |
| H3_Bri_HA_CR9114 | 7.8 | <7 | 9.4 | 8.6 | 9.9 | | | <7 |
| H3_Bri_HA_SD1036 | | | 9.1 | 7.9 | | | | <7 |
| H3_Bri_HA_SD1038 | | | 9.3 | 8.3 | | <7 | <7 | <7 |
| H3_Bri_HA_39.29 | | | 9.2 | 8.3 | | | | <7 |
| H3_Wis_HA_CR9114 | <7 | <7 | 7.8 | 8.0 | | | | |
| H3_Wis_HA_CR8020 | <7 | <7 | 7.2 | 7.2 | | | | |
| H3_Wis_HA_CR8057 | <7 | <7 | <7 | <7 | | | | |
| H7_Net_HA_CR9114 | 9.2 | <7 | 9.3 | 7.5 | | | | |
| H7_Net_HA_SD1038 | | | | | | <7 | <7 | |

TABLE 11

SdAb competition for binding to influenza B HA.

| | SD1014 | SD1036 | SD1038 | SD1083 | SD1084 | SD1085 | SD1086 | SD1087 |
|---|---|---|---|---|---|---|---|---|
| B_Bri_HA_CR8071 | | | | <7 | <7 | | <7 | <7 |
| B_Bri_HA_CR9114 | <7 | <7 | <7 | 9.4 | 7.4 | | 8.6 | 7.5 |
| B_Bri_HA_SD1083 | | <7 | | 8.9 | | | | |
| B_Bri_HA_SD1084 | | <7 | | <7 | 9.7 | | | |
| B_Bri_HA_SD1085 | | <7 | | 8.7 | | | | |
| B_Bri_HA_SD1086 | | <7 | | 9.1 | | | | |
| B_Bri_HA_SD 087 | | <7 | | 9.0 | <7 | | | |
| B_Flo_HA_CR8033 | | | | <7 | 8.5 | <7 | <7 | <7 |
| B_Flo_HA_CR8071 | | | | <7 | <7 | | <7 | |
| B_Flo_HA_CR9114 | | | | 9.3 | 8.0 | | 8.0 | 8.8 |
| B_Flo_HA_SD1083 | | <7 | | 9.0 | | | | |
| B_Flo_HA_SD1084 | | <7 | | <7 | | | | |
| B_Flo_HA_SD1085 | | <7 | | 8.9 | | | | |
| B_Flo_HA_SD1086 | | <7 | | 9.2 | | | | |
| B_Flo_HA_SD1087 | | <7 | | 9.1 | | | | |

Block of Receptor Binding—Hemagglutination Inhibition The hemagglutination inhibition assay, a common variation of the HA assay, was used to test sdAbs for the ability to bind near the top of the HA head-region and physically block the interaction with sialic acid receptors on target cells, here red blood cells. If an sdAb at sufficient concentration blocks the interaction with sialic acid then "agglutination" (red blood cells clumping together) is inhibited. A serial dilution of sdAbs was prepared in PBS (25 µL/well) and 25 µL of 8 HAU/50 µL virus dilution was added and mixed. After incubation for 1 h at 37° C., 50 µL of 1% turkey red blood cells (TRBC) were added and mixed. After incubation for 30 to 60 min at RT the agglutination pattern is scored visually (tear formation). Besides quadruplicate samples and positive control antibodies, a back titration of the input virus is taken along. The hemagglutination inhibition titer, the minimal concentration at which all interaction of virus with sialic acid receptors on TRBC is blocked was calculated using the Spearman-Karber formula.
The results are shown in Table 12. All influenza A binding sdAbs were negative (i.e. having HI titers >50 µg/mL).

TABLE 12

Hemagglutination inhibition titers (µg/mL) of single domain antibodies (empty cells mean 'not tested').

| | B | | | | H5N1 |
|---|---|---|---|---|---|
| | B/Brisbane/ 60/08 | B/Florida/ 04/06 | B/Harbin/ 7/94 | B/Lee/ 40 | A/Vietnam/ 1194/04 |
| SD1083 | >50 | >50 | >50 | >50 | >50 |
| SD1084 | 0.07 | 0.42 | 1.10 | | >50 |
| SD1087 | >50 | >50 | >50 | >50 | >50 |

In conjunction with its binding and neutralization profile, SD1084 was shown to be a potent HA head binder and prevents the binding to sialic acid receptors.

Inhibition of Conformational Change of HA by Stem Binding sdAbs

To prove that stem binding sdAbs, similarly to the antibodies they compete with, prevent the conformational change of HA and thereby block viral fusion and subsequent infection, an assay has been developed which measures the presents of the HA head (HA1) after low pH treatment and reduction of the connecting disulfide bridge between HA1 and HA2 (Brandenburg et al. 2013).

The conformational change assay is based on label-free detection and performed using the biolayer interferometry platform Octet Red384 (Forté Bio, Pall). First a batch of C-terminally biotinylated recombinant HA is cleaved (250 µg of HA incubated with 10 µL 0.05% Trypsin-EDTA for 20 min at 37° C. then 30 µL DTI are added to stop the Trypsin activity). The HA (2 µg/mL) is then captured on streptavidin sensors (Forte Bio, cat #18-5020) in the Octet subsequently incubated with the binding partner (sdAbs, positive and negative control antibodies at up to 50 nM). After this incubation step, the sensors will be exposed to a pH range (pH6.5 to 5.0 in 0.2 pH steps). If the binding partner does not stabilize and arrest HA it will undergo conformational change; the HA1 head domain moves away while the HA2 domain, encompassing the fusion machinery, refolds and protrudes the fusion peptide outwards. HA1 will now only be connected to HA2 via a disulfide bridge that can be reduced by DTT exposure in the final assay step (50 mM DTT in PBS). HA1 will then dissociate from the biotinylated HA2 domain, resulting in the detection of a significant loss of mass on the detector. Results are summarized in Table 13.

TABLE 13

Prevention of conformational change of HA by single domain antibodies.

| | H1 A/Brisbane/ 59/07 | H3 A/HK/1/ 68-MA | H7 A/NIBRG/60 (A/mallard/ NL/12/00) | H7 A/Hangzhou/ 1/2013 | Victoria B/Brisbane/ 60/08 |
|---|---|---|---|---|---|
| SD1036 | − | ++ | ++ | ++ | − |
| SD1038 | ++ | + | +/− | +/− | − |
| SD1046 | + | ++ | | | − |
| SD1069 | ++ | ++ | | | − |
| SD1083 | − | − | | | ++ |
| SD1084 | − | − | | | − |
| SD1087 | − | − | | | ++ |

'++' refers to strong and '+' to medium inhibition of conformational change of HA.
'−' refers to no inhibition.
Empty cells mean 'not tested'.

The results show that the HA stem binding sdAbs are capable of preventing the conformational change of HA according to their neutralization profile. This ability requires the sdAb to stay bound at low pH similar to the conditions in late endosomes. The level of block of the conformational change is positively correlated with their neutralization titer on the respective influenza strains.

Single Domain Antibody Sequences

The sequences of selected and characterized sdAbs according to the invention are listed in Table 14. The sequences of the CDR regions are listed in Table 14a.

TABLE 14

Sequences of single domain antibodies according to the invention.

| Class | Single Domain | Sequence | SEQ ID NO: |
|---|---|---|---|
| A g1 | SD1018 | EVQLVESGGGLVQAGGSLRLSCAASGQTYHMGWFRQTPGNERESVAAVTWSGAVTRYADSVKGRFTISR DNAKNTVYLQMNSLVPEDTAIYYCAATRSMAPIIQLSPGSYDYWGPGTQVTVSS | 1 |
| A g1 | SD1071 | EVQLVESGGGLVQTGESLRLSCAFSGFTYSTYWMYWVRQGPEKGLKWVSSTNAAGTVTYYAANVRDRFT ASKDNAKNTLYLQMNRLKPEDTGLYYCASKDGLIVAATLDDYDYRGQGTQVTVSS | 2 |
| A g1 | SD1035 | EVQLVESGGGLVQAGGTLRLSCAASGSAVSISRMAWYRQAPGKQRELVADIFSGGGTNYADSVKGRFTI SRDNAKNTVDLQMNSLKPEDTAVYYCSARSAVAAIHWDQYDYWGQGTQVTVSS | 3 |
| A g1 | SD1016 | EVQLVESGGGLVQAGGSLRLSCVASGMFFGIAAMGWYRQAPGKQRELVANITSDFSTNYADSVKDRFTI SRDNAENTVYLQMNSLKPEDTAVYYCAADSLGTGWRHYYYWGQGTQVTVSS | 4 |
| A g1 | SD1072 | EVQLVESGGGLVEAGGSLRLSCAVSGRTFSMYATGWFRQAPGKEREFVAAINSSGDKTTYADSVEGRFT ISRDIGTVYLQMNNLNPEDTAVYYCAAARTLAVVTIPGGYEYWGWGTQVTVSS | 5 |

TABLE 14-continued

Sequences of single domain antibodies according to the invention.

| Class | Single Domain | Sequence | SEQ ID NO: |
|---|---|---|---|
| A g1 | SD1074 | EVQLVESGGGLVQAGGSLRLSCAASRNFDAIGAMGWYRQAPGKQRELVAEITSDGSTNYTDSVKGRFTISRDNALRTMYLQMNALEPEDTAVYYCKADISIYGLTNFPYWGQGTQVTVSS | 6 |
| A g1 | SD1076 | EVQLVESGGGLVQAGGSLTLSCAGSGFAFSIATMGWYRQAPGKQRELVADITSGGSTNYADSVKGRFTISRDNAKNTVYLQMNSLKPEDTAVYYCNADSLATGWRQYSYWGKGTQVTVSS | 7 |
| A g2 | SD1017 | EVQLVESGGGLVQAGGSLRLSCAASGRTYAMAWFRQAPGKEREFVAHINALGTRAYYSDSVEGRFTISRDNAKNTGYLQMNSLEPEDTAVYVCAAGGQWRAAPVADAAQYDFWGQGTQVTVSS | 8 |
| A g2 | SD1025 | EVQLVESGGGLVQAGGSLRLSCAASGRTYAMAWFRQAPGKEREFVAHINALGTRTYYSDSVQGRFTISRDNAKNTEYLQMNSLKPEDTAVYYCAAGGQWRAAPVADAAQYDFWGQGTQVTVSS | 9 |
| A g2 | SD1070 | EVQLVESGGGLVQAGGSLRISCAASGRTFSIYSMGWFRQAPGKEREFVATIGWNSGRTFYADSMKERFTISADNARNTLYLQMNSLKFEDTAVYYCAAAKGPLRLSSQADYWGQGTQVTVSS | 10 |
| A g2 | SD2020 | EVQLVESGGGLVQPGGSLRLSCAAAGGAFNRQLVAWFRQAPGKKREFVATVTTSGGSSYYADSVKGRFTISRDTAKNTVALQMNSLKAEDAAVYYCAARDSFTVAPYYPPESYAYWGQGTQVTVSS | 11 |
| A g1 + g2 | SD1069 | EVQLVESGGGLVQAGDSLRLSCAASGPTFGMSAMGWFRQAPGKEREFVAAISGLGNPNYSDDVKGRFTISRENGRNTVYLQMNSLKPEDTAVYYCAQRKVYHVQGGDRPQAYDYWGQGTQVTVSS | 12 |
| A g1 + g2 | SD1046 | EVQLVESGGGLVQAGDSLRISCAASGRTLSIYSMGWFRQAPGKEREFVATIGWNSGRTFYPDSLKGRFTISRDNARNTLYLQMNNLRPEDTAVYYCAAAKGPLRLSSQADYWGQGTQVTVSS | 13 |
| A g1 + g2 | SD1048 | EVQLVESGGGVVQPGGSLRLSCVASGRTSSMYSIGWFRQAPGKEREFVAVIGWYSGRTFYTDSMKGRFTISRDNARNTVYLQMNSLKPEDTAVYYCAAANGPLRLSNQADYWGQGTQVTVSS | 14 |
| A g1 + g2 | SD1049 | EVQLVESGGGLVQAGGSLRLSCAASGRTLSLYSVGWFRQAPGKEREFVATIGWNSGRTFYVDSMKGRFTISRDNAKNTVYLQMNDLKVEDTAVYYCAAAKGPLRLSNQADYWGWGTQVTVSS | 15 |
| A g1 + g2 | SD1027 | EVQLVESGGGMVQAGGSLRLSCAASGGTFSLYHMGWFRQAPGEEREFVAAISGSGGNTYYADSVKGRFTISRDNNKNTVYLQMSSLEPEDTAVYFCAAMKWPGILRDANAYDYWGQGTQVTVSS | 16 |
| A g1 + g2 | SD1036 | EVQLVESGGGLVQAGGSLKLSCAASGRTYAMGWFRQAPGKEREFVAHINALGTRTYYSDSVKGRFTISRDNAKNTEYLEMNNLKPEDTAVYYCTAWGQWRAAPVAVAAEYEFWGWGTQVTVSS | 17 |
| A g1 + g2 | SD1014 | EVQLVESGGGLVQAGGSLTLSCAASGRTYAMAWFRQAPGKEREFVAHINALGTRTYYSDSVKGRFTISRDNAKNTEYLQMNSLNPEDTAVYYCAAGGQWRAAPVADAAQYDFWGQGTQVTVSS | 18 |
| A g1 + g2 | SD1047 | EVQLVESGGGLVQAGGSLRISCAASGRTYAMAWFRQAPGKEREFVAHINALGTRTYYSDSVKDRFTISRDNAKNTEYLQMNSLKPEDTAVYYCVAGGQWRAAPVAAAESYDFWGQGTQVTVSS | 19 |
| A g1 + g2 | SD1038 | EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSS | 20 |
| A g1 + g2 | SD1045 | EVQLVESGGGLVQAGGSLRLSCAASGSSFSINVMGWYRQAPGKQREMVATITYGGSTNYVDSVKGRFTISRDNAKNTVYLQMNSLKPEDTAVYYCNSRLAQINYWGQGTQVTVSS | 21 |
| A g1 + g2 | SD1073 | EVQLVESGGGLVQAGGSLRLSCAASGSAFSIAAMGWYRQAPGKQRELVATITTGGSTNYADSVKGRFTISRDNSKNTAYLQMNSLKPEDTAVYYCTAKSVVAETFGDLYNYWGQGTQVTVSS | 22 |
| A g1 + g2 | SD1034 | EVQLVESGGGLVQAGGSLRLSCAASGTIFGIRVNTMGWYRQAPGEQRELVATITRSGGTNYADSVKDRFTISGDFAKDTVYLQMMHLKPEDTAVYYCNGRWALTDYWGQGTQVTVSS | 23 |
| B | SD1083 | EVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSS | 24 |
| B | SD1084 | EVQLVESGGGLVQPGGSLKLSCAASGFTFSTSWMYWLRQAPGKGLEWVSVINTDGGTYYADSVKDRFTISRDNAKDTLYLQMSSLKSEDTAVYYCAKDWGGPEPTRGQGTQVTVSS | 25 |
| B | SD1085 | EVQLVESGGGLVQAGDSLRLSCVISGLSLDTYAVGWFRQAPGKEREGITCISSGHGMTYYADSVKGRFTVSTDNAKNTVYLQMNGLQPEDTARYYCATESRYYCSDNWPAPQRYIYWGQGTQVTVSS | 26 |
| B | SD1087 | EVQLVESGGGLVQPGGSLRLSCVISGLSLDTYAVGWFRQAPGKEREGITCISSGHGMTYYADSVKGRFTVSTDNAKNTVYLQMNGLQPEDTARYYCATESRYYCSDNWPAPQRYIYWGQGTQVTVSS | 27 |
| B | SD1086 | EVQLVESGGGLVQAGGSLRLSCTASGSISSIDYMRWYRQYPGKHRELVATITSGGAADSRDSVKGRFTVSRGNAANTMYLQMNNLKPEDTAVYYCNAYGLEIGAHWGRGTQVTVSS | 28 |
| B | SD2086 | EVQLVESGGGLVQAGGSLRLSCATSGQTFSSYAMGWFRQAPGKEREFVAAISWNGGSTYYADSVKGRFTISRESPENLVYLQMNSLKPEDTAVYYCAARGAYYTGSYYLGSTYDYWGQGTQVTVSS | 29 |

TABLE 14a

Sequences of CDR regions of single domain antibodies according to the invention

| | CDR1 (SEQ ID NO) | CDR2 (SEQ ID NO) | CDR3 (SEQ ID NO) |
|---|---|---|---|
| SD1018 | QTYHMG (227) | AVTWSGAV (228) | AATRSMAPIIQLSPGSYDY (229) |
| SD1071 | FTYSTYWMY (230) | STNAAGTV (231) | ASKDGLIVAATLDDYDY (232) |
| SD1035 | SAVSISRMA (233) | DIFSGGG (234) | SARSAVAAIHWDQYDY (235) |
| SD1016 | MFFGIAAMG (236) | NITSDFS (237) | AADSLGTGWRHYYY (238) |
| SD1072 | RTFSMYATG (239) | AINSSGDK (240) | AAARTLAVVTIPGGYEY (241) |
| SD1074 | NFDAIGAMG (242) | EITSDGS (243) | KADISIYGLTNFPY (244) |
| SD1076 | FAFSIATMG (245) | DITSGGS (246) | NADSLATGWRQYSY (247) |
| SD1017 | RTYAMA (248) | HINALGTR (249) | AAGGQWRAAPVADAAQYDF (250) |
| SD1025 | RTYAMA (251) | HINALGTR (252) | AAGGQWRAAPVADAAQYDF (253) |
| SD1070 | RTFSIYSMG (254) | TIGWNSGR (255) | AAAKGPLRLSSQADY (256) |
| SD2020 | GAFNRQLVA (257) | TVTTSGGS (258) | AARDSFTVAPYYPPESYAY (259) |
| SD1069 | PTFGMSAMG (260) | AISGLGN (261) | AQRKVYHVQGGDRPQAYDY (262) |
| SD1046 | RTLSIYSMG (263) | TIGWNSGR (264) | AAAKGPLRLSSQADY (265) |
| SD1048 | RTSSMYSIG (266) | VIGWYSGR (267) | AAANGPLRLSNQADY (268) |
| SD1049 | RTLSLYSVG (269) | TIGWNSGR (270) | AAAKGPLRLSNQADY (271) |
| SD1027 | GTFSLYHMG (272) | AISGSGGN (273) | AAMKWPGILRDANAYDY (274) |
| SD1036 | RTYAMG (275) | HINALGTR (276) | TAQGQWRAAPVAVAAEYEF (277) |
| SD1014 | RTYAMA (278) | HINALGTR (279) | AAGGQWRAAPVADAAQYDF (280) |
| SD1047 | RTYAMA (281) | HINALGTR (282) | VAGGQWRAAPVAAAESYDF (283) |
| SD1038 | SIFDIYAMD (284) | TSFRDGS (285) | HVSLYRDPLGVAGGMGVY (286) |
| SD1045 | SSFSINVMG (287) | TITYGGS (288) | NSRLAQINY (289) |
| SD1073 | SAFSIAAMG (290) | TITTGGS (291) | TAKSVVAETFGDLYNY (292) |
| SD1034 | TIFGIRVNTMG (293) | TITRSGG (122) | NGRWALTDY (123) |
| SD1083 | FTLENKAIG (124) | CISKSGSW (125) | ATTTAGGGLCWDGTTFSRLASS (126) |
| SD1084 | FTFSTSWMY (127) | VINTDGG (128) | AKDWGGPEPT (129) |
| SD1085 | LSLDTYAVG (130) | CISSGHGM (131) | ATESRYYCSDNWPAPQRYIY (132) |
| SD1087 | LSLDTYAVG (133) | CISSGHGM (134) | ATESRYYCSDNWPAPQRYIY (135) |
| SD1086 | SISSIDYMR (136) | TITSGGA (137) | NAYGLEIGAH (138) |
| SD2086 | QTFSSYAMG (139) | AISWNGGS (140) | AARGAYYTGSYYLGSTYDY (141) |

In conclusion, virus neutralization assays performed with purified, monomeric sdAb constructs confirmed the four different classes of sdAbs: influenza A group 1, A group 2, A group 1 and group 2, or influenza B neutralizing sdAbs. Nevertheless, binding studies indicate that many A group 1 or A group 2 neutralizing sdAb can also bind HA belonging to the group they fail to neutralize. This results in a significantly larger number of A group 1 and A group 2 binding sdAbs. SdAb which can neutralize or at least bind influenza A and B where not found. SdAbs capable of broadly binding and neutralizing where selected for further characterization (including SD1038, SD1036, SD1083, and SD1084). Determination of the affinity towards HA shows a positive correlation between binding strength and neutralization titer of selected sdAbs. Epitope mapping via competition assays with known HA binding molecules revealed that all but SD1084 bind to the conserved stem of HA. The concentration at which the competition occurred is positively correlated with the neutralization titer meaning that stronger binding and competition results in lower neutralization titers. SD1084 on the other hand binds near or at the sialic acid binding site of the HA head, as demonstrated in the hemagglutination inhibition assay, and can prevent the cellular entry of influenza virus by blocking the receptor binding. All other selected sdAbs can bind HA1 and HA2 in the stem of HA and prevent the conformational change of HA during the fusion process as demonstrated in the conformational change assay.

Example 7: Generation and Characterization of sdAb Homo- and Heterodimers

Generation of sdAb Homo- and Heterodimers

For the creation of sdAb homo- and heterodimers the sdAb coding sequences were either cloned together or the full-length gene was directly synthesized (Genscript) and ligated into the eukaryotic expression vector. In the sdAb dimer constructs the C-terminus of the first sdAb (front) was linked to the N-terminus of the second sdAb (back). The linker sequences of different length (10, 15, 35, and 57 amino acids) consist of amino acids glycine (G) and serine (S). When cloned together, a restriction site (NotI) directly following the first sdAb results in three additional alanine (A) residues. Linker sequences are shown in Table 15 and complete amino acid sequences of the sdAb dimers are shown in Table 16 (influenza A targeting constructs) and in Table 17 (influenza B targeting constructs). The position of sdAbs (front or back) was varied in constructs to allow for the most optimal combination. Expression and purification were performed as described in Example 5.

TABLE 15

Linker sequences for generation of multi-domain antibody constructs.

| Type | Sequence |
| --- | --- |
| 10GS-linker | GGGGS GGGGS (SEQ ID NO: 142) |
| 15GS-linker | GGGGS GGGGS GGGGS (SEQ ID NO: 143) |
| 35GS-linker | GGGGS GGGGS GGGGS GGGGS GGGGS GGGGS GGGGS (SEQ ID NO: 144) |
| 57GS-linker | GGGGS GGGGS GGGGS GGGGS GGGGGGS GGGGS GGGGS GGGGS GGGGS GGGGS GGGGS (SEQ ID NO: 145) |

TABLE 16

Sequences of SD1036 and SD1038 homo- and heterodimers.

| Construct | Sequence | SEQ ID NO: |
| --- | --- | --- |
| MD1213 | EVQLVESGGGLVQAGGSLKLSCAASGRTYAMGWFRQAPGKEREFVAHINALGTRTYYSDSVKGRFTISR DNAKNTEYLEMNNLKPEDTAVYYCTAQGQWRAAPVAVAAEYEFWGQGTQVTVSSAAAGGGGSGGGGSGG GGSEVQLVESGGGLVQAGGSLKLSCAASGRTYAMGWFRQAPGKEREFVAHINALGTRTYYSDSVKGRFT ISRDNAKNTEYLEMNNLKPEDTAVYYCTAWGQWRAAPVAVAAEYEFWGWGTQVTVSS | 30 |
| MD1209 | EVQLVESGGGLVQAGGSLKLSCAASGRTYAMGWFRQAPGKEREFVAHINALGTRTYYSDSVKGRFTISR DNAKNTEYLEMNNLKPEDTAVYYCTAQGQWRAAPVAVAAEYEFWGQGTQVTVSSAAAGGGGSGGGGSGG GGSGGGGSGGGGSGGGGSGGGGSEVQLVESGGGLVQAGGSLKLSCAASGRTYAMGWFRQAPGKEREFVA HINALGTRTYYSDSVKGRFTISRDNAKNTEYLEMNNLKPEDTAVYYCTAQGQWRAAPVAVAAEYEFWGQ GTQVTVSS | 31 |
| MD1215 | EVQLVESGGGLVQAGGSLKLSCAASGRTYAMGWFRQAPGKEREFVAHINALGTRTYYSDSVKGRFTISR DNAKNTEYLEMNNLKPEDTAVYYCTAQGQWRAAPVAVAAEYEFWGQGTQVTVSSAAAGGGGSGGGGSGG GGSGGGGSGGGGGSGGGGSGGGGSGGGGSGGGGSGGGGSGGGGSEVQLVESGGGLVQAGGSLKLSCAA SGRTYAMGWFRQAPGKEREFVAHINALGTRTYYSDSVKGRFTISRDNAKNTEYLEMNNLKPEDTAVYYC TAWGQWRAAPVAVAAEYEFWGWGTQVTVSS | 32 |
| MD1214 | EVQLVESGGGLVQPGGSLRLSCAVSISIFDIYAMDWYRQAPGKQRDLVATSFRDGSTNYADSVKGRFTI SRDNAKNTLYLQMNSLKPEDTAVYLCHVSLYRDPLGVAGGMGVYWGKGALVTVSSAAAGGGGSGGGGSG GGGSEVQLVESGGGLVQAGGSLKLSCAASGRTYAMGWFRQAPGKEREFVAHINALGTRTYYSDSVKGRF TISRDNAKNTEYLEMNNLKPEDTAVYYCTAQGQWRAAPVAVAAEYEFWGWGTQVTVSS | 33 |
| MD1211 | EVQLVESGGGLVQPGGSLRLSCAVSISIFDIYAMDWYRQAPGKQRDLVATSFRDGSTNYADSVKGRFTI SRDNAKNTLYLQMNSLKPEDTAVYLCHVSLYRDPLGVAGGMGVYWGKGALVTVSSAAAGGGGSGGGGSG GGGSGGGGSGGGGSGGGGSGGGGSEVQLVESGGGLVQAGGSLKLSCAASGRTYAMGWFRQAPGKEREFV AHINALGTRTYYSDSVKGRFTISRDNAKNTEYLEMNNLKPEDTAVYYCTAQGQWRAAPVAVAAEYEFWG QGTQVTVSS | 34 |
| MD1210 | EVQLVESGGGLVQAGGSLKLSCAASGRTYAMGWFRQAPGKEREFVAHINALGTRTYYSDSVKGRFTISR DNAKNTEYLEMNNLKPEDTAVYYCTAQGQWRAAPVAVAAEYEFWGQGTQVTVSSAAAGGGGSGGGGSGG GGSGGGGSGGGGSGGGGSGGGGSEVQLVESGGGLVQPGGSLRLSCAVSISIFDIYAMDWYRQAPGKQRD LVATSFRDGSTNYADSVKGRFTISRDNAKNTLYLQMNSLKPEDTAVYLCHVSLYRDPLGVAGGMGVYWG KGALVTVSS | 35 |
| MD1212 | EVQLVESGGGLVQPGGSLRLSCAVSISIFDIYAMDWYRQAPGKQRDLVATSFRDGSTNYADSVKGRFTI SRDNAKNTLYLQMNSLKPEDTAVYLCHVSLYRDPLGVAGGMGVYWGKGALVTVSSAAAGGGGSGGGGSG GGGSGGGGSGGGGSGGGGSGGGGSEVQLVESGGGLVQPGGSLRLSCAVSISIFDIYAMDWYRQAPGKQR DLVATSFRDGSTNYADSVKGRFTISRDNAKNTLYLQMNSLKPEDTAVYLCHVSLYRDPLGVAGGMGVYW GKGALVTVSS | 36 |
| MD1216 | EVQLVESGGGLVQPGGSLRLSCAVSISIFDIYAMDWYRQAPGKQRDLVATSFRDGSTNYADSVKGRFTI SRDNAKNTLYLQMNSLKPEDTAVYLCHVSLYRDPLGVAGGMGVYWGKGALVTVSSAAAGGGGSGGGGSG GGGSGGGGSGGGGGSGGGGSGGGGSGGGGSGGGGSGGGGSEVQLVESGGGLVQAGGSLKLSCA ASGRTYAMGWFRQAPGKEREFVAHINALGTRTYYSDSVKGRFTISRDNAKNTEYLEMNNLKPEDTAVYY CTAWGQWRAAPVAVAAEYEFWGWGTQVTVSS | 37 |

TABLE 17

Sequences of SD1083 and SD1084 homo- and heterodimers.

| Construct | Sequence | SEQ ID NO: |
|---|---|---|
| MD1221 | EVQLVESGGGLVWPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSSAAAGGGGSGGGGSGGGGSGGGGSGGGGSGGGGSGGGGSEVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSS | 38 |
| MD1222 | EVQLVESGGGLVWPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSSAAAGGGGSGGGSGGGGSGGGGSGGGGSGGGGSGGGGSEVQLVESGGGLVWPGGSLKLSCAASGFTFSTSWMYWLRQAPGKGLEWVSVINTDGGTYYADSVKDRFTISRDNAKDTLYLQMSSLKSEDTAVYYCAKDWGGPEPTRGQGTQVTVSS | 39 |
| MD1223 | EVQLVESGGGLVWPGGSLKLSCAASGFTFSTSWMYWLRQAPGKGLEWVSVINTDGGTYYADSVKDRFTISRDNAKDTLYLQMSSLKSEDTAVYYCAKDWGGPEPTRGQGTQVTVSSAAAGGGGSGGGGSGGGGSGGGGSGGGGSGGGGSGGGGSEVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSS | 40 |
| MD1224 | EVQLVESGGGLVWPGGSLKLSCAASGFTFSTSWMYWLRQAPGKGLEWVSVINTDGGTYYADSVKDRFTISRDNAKDTLYLQMSSLKSEDTAVYYCAKDWGGPEPTRGQGTQVTVSSAAAGGGGSGGGGSGGGGSGGGGSGGGGSGGGGSGGGGSEVQLVESGGGLVWPGGSLKLSCAASGFTFSTSWMYWLRQAPGKGLEWVSVINTDGGTYYADSVKDRFTISRDNAKDTLYLQMSSLKSEDTAVYYCAKDWGGPEPTRGQGTQVTVSS | 41 |

Influenza Neutralization by sdAb Homo- and Heterodimers

Purified sdAb homo- and heterodimers were tested in influenza virus neutralization assays as described in Example 6 and showed improved potency and breadth when compared to sdAb building blocks. Results are shown for influenza A neutralizing dimers in Table 18 and for influenza B neutralizing dimers in Table 19.

TABLE 18

Influenza neutralization titers of SD1036 and SD1038 homo- and heterodimers (titers of sdAbs SD1036 and SD1038 are also listed for comparison, empty cells mean 'not tested').

| Construct | H1N1 A/California/ 07/09 | H1N1 A/Puerto Rico/ 8/34-MA | H5N1 A/Vietnam/ 1194/04 | H3N2 A/Wisconsin/ 67/05 |
|---|---|---|---|---|
| SD1036 | <1000 | <1000 | <1000 | <1000 |
| SD1038 | 17.5 | 8.8 | 30.1 | <1000 |
| MD1213 | 2.4 | 27.8 | <1000 | 18.6 |
| MD1209 | 10.1 | 221.2 | <1000 | 109.1 |
| MD1215 | 4.1 | 39.6 | 917.9 | 34.1 |
| MD1212 | 3.7 | 11.7 | 14.8 | 49.5 |
| SD1036 + SD1038 | | 6.8 | 19.3 | <1000 |
| MD1214 | 1.4 | 7.5 | 0.9 | 12.5 |
| MD1211 | 4.0 | 9.9 | 7.6 | 19.3 |
| MD1210 | 2.5 | 21.9 | 21.4 | 118.3 |
| MD1216 | 1.4 | 9.7 | 3.4 | 12.1 |

TABLE 19

Influenza neutralization titers of SD1083 and SD1084 homo- and heterodimers (titers of sdAbs SD1083 and SD1084 are also listed for comparison, empty cells mean 'not tested').

| | Victoria | | Yamagata | | Old |
|---|---|---|---|---|---|
| Construct | B/Brisbane/ 60/08 | B/Malaysia/ 2506/04 | B/Florida/ 04/06 | B/Harbin/ 7/94 | B/Lee/ 40 |
| SD1083 | 178.5 | 293.8 | 219.7 | 258.9 | 216.7 |
| SD1084 | 20.5 | 34.9 | 68.8 | 240.0 | <1000 |
| MD1221 | 23.4 | | 76.4 | | 32.5 |
| MD1222 | 3.0 | 3.6 | 2.1 | 7.2 | 12.7 |

TABLE 19-continued

Influenza neutralization titers of SD1083 and SD1084 homo- and heterodimers (titers of sdAbs SD1083 and SD1084 are also listed for comparison, empty cells mean 'not tested').

| | Victoria | | Yamagata | | Old |
|---|---|---|---|---|---|
| Construct | B/Brisbane/ 60/08 | B/Malaysia/ 2506/04 | B/Florida/ 04/06 | B/Harbin/ 7/94 | B/Lee/ 40 |
| MD1223 | | | 2.3 | | 18.0 |
| MD1224 | 4.1 | 2.7 | 0.8 | 4.5 | 33.0 |

HA Binding of sdAb Homo- and Heterodimers

Purified sdAb homo- and heterodimers were tested in binding assays as described in Example 6 and showed improved binding strength (avidity) when compared to sdAb building blocks. Results are shown for influenza A neutralizing dimers in Table 20.

TABLE 20

Geomean KD values (nM) of SD1036 and SD1038 homo- and heterodimers (empty cells mean 'not tested').

| | H1N1 A/New Caledonia/ 20/1999 | H3N2 A/Wisconsin/ 67/05 | H3N2 A/Brisbane/ 10/2007 | H7N3 A/NIBRG/60 (A/mallard/ NL/12/00) |
|---|---|---|---|---|
| MD1210 | 0.7 | | 1.7 | 1.2 |
| MD1212 | 1.4 | 0.8 | 2.3 | 1.5 |
| MD1211 | 1.7 | 0.9 | 1.8 | 2.1 |
| MD1209 | 1.9 | | 1.8 | 1.4 |

Example 8: Generation and Characterization of Multi-Domain Antibody Constructs

Generation of sdAb Multimers

For the creation of sdAb multimers (trimers, tetramers and pentamers) the sdAb coding sequences were either cloned together or the full-length gene was directly synthesized (Genscript) and ligated into the eukaryotic expression vector. The linker sequences of different length (10 or 35 amino acids) consist of amino acids glycine (G) and serine (S). When cloned together, a restriction site (NotI) directly following the first sdAb results in three additional alanine (A) amino acids and 2 consecutive restriction sites (PacI and XhoI) directly following the second sdAb results in five additional amino acids (LINLE). Linker sequences are shown in Table 15 and complete amino acid sequences of sdAb trimers are shown in Table 23 and of sdAb tetramers and pentamers in Table 24. The position of sdAbs within constructs was varied to allow for the most optimal combination. Expression and purification were performed as described in Example 5.

TABLE 23

Sequences of trimeric multi-domain antibody constructs.

| Construct (SEQ ID NO:) | Sequence |
|---|---|
| MD1301 (42) | EVQLVESGGGLVWPGGSLRLSCAVSISIFDIYAMDWYRQAPGKQRDLVATSFRDGSTNYADSVKGRFTISRDNAKNTL YLQMNSLKPEDTAVYLCHVSLYRDPLGVAGGMGVYWGKGALVTVSSAAAGGGGSGGGGSGGGGSGGGGSGGGGSGGGG SGGGGSEVQLVESGGGLVQAGGSLKLSCAASGRTYAMGWFRQAPGKEREFVAHINALGTRTYYSDSVKGRFTISRDNA KNTEYLEMNNLKPEDTAVYYCTAQGQWRAAPVAVAAEYEFWGQGTQVTVSSLINLEGGGGSGGGGSGGGGSGGGGSGG GGSGGGGSGGGGSPAGEVQLVESGGGLVQPGGSLRLSCAATGFTLENKAIGWFRQTPGSEREGVLCISKSGSWTYYTD SMRGRFTISRDNAENTVYLQMDSLKPEDTAVYYCATTTAGGGLCWDGTTFSRLASSWGQGTQVTVSS |
| MD1302 (43) | EVQLVESGGGLVWPGGSLRLSCAVSISIFDIYAMDWYRQAPGKQRDLVATSFRDGSTNYADSVKGRFTISRDNAKNTL YLQMNSLKPEDTAVYLCHVSLYRDPLGVAGGMGVYWGKGALVTVSSAAAGGGGSGGGGSGGGGSGGGGSGGGGSGGGG SGGGGSEVQLVESGGGLVQAGGSLKLSCAASGRTYAMGWFRQAPGKEREFVAHINALGTRTYYSDSVKGRFTISRDNA KNTEYLEMNNLKPEDTAVYYCTAQGQWRAAPVAVAAEYEFWGQGTQVTVSSLINLEGGGGSGGGGSGGGGSGGGGSGG GGSGGGGSGGGGSPAGEVQLVESGGGLVQPGGSLKLSCAASGFTFSTSWMYWLRQAPGKGLEWVSVINTDGGTYYADS VKDRFTISRDNAKDTLYLQMSSLKSEDTAVYYCAKDWGGPEPTRGQGTQVTVSS |
| MD2301 (44) | EVQLVESGGGLVWPGGSLRLSCAATGFTLENKAIGWFRQTPGSEREGVLCISKSGSWTYYTDSMRGRFTISRDNAENT VYLQMDSLKPEDTAVYYCATTTAGGGLCWDGTTFSRLASSWGQGTQVTVSSGGGGSGGGGSEVQLVESGGGLVQPGGS LRLSCAVSISIFDIYAMDWYRQAPGKQRDLVATSFRDGSTNYADSVKGRFTISRDNAKNTLYLQMNSLKPEDTAVYLC HVSLYRDPLGVAGGMGVYWGKGALVTVSSGGGGSGGGGSEVQLVESGGGLVQAGGSLKLSCAASGRTYAMGWFRQAPG KEREFVAHINALGTRTYYSDSVKGRFTISRDNAKNTEYLEMNNLKPEDTAVYYCTAQGQWRAAPVAVAAEYEFWGQGT QVTVSS |
| MD2302 (45) | EVQLVESGGGLVWPGGSLRLSCAVSISIFDIYAMDWYRQAPGKQRDLVATSFRDGSTNYADSVKGRFTISRDNAKNTL YLQMNSLKPEDTAVYLCHVSLYRDPLGVAGGMGVYWGKGALVTVSSGGGGSGGGGSEVQLVESGGGLVQPGGSLRLSC AATGFTLENKAIGWFRQTPGSEREGVLCISKSGSWTYYTDSMRGRFTISRDNAENTVYLQMDSLKPEDTAVYYCATTT AGGGLCWDGTTFSRLASSWGQGTQVTVSSGGGGSGGGGSEVQLVESGGGLVQAGGSLKLSCAASGRTYAMGWFRQAPG KEREFVAHINALGTRTYYSDSVKGRFTISRDNAKNTEYLEMNNLKPEDTAVYYCTAQGQWRAAPVAVAAEYEFWGQGT QVTVSS |
| MD2303 (46) | EVQLVESGGGLVWPGGSLRLSCAVSISIFDIYAMDWYRQAPGKQRDLVATSFRDGSTNYADSVKGRFTISRDNAKNTL YLQMNSLKPEDTAVYLCHVSLYRDPLGVAGGMGVYWGKGALVTVSSGGGGSGGGGSEVQLVESGGGLVQAGGSLKLSC AASGRTYAMGWFRQAPGKEREFVAHINALGTRTYYSDSVKGRFTISRDNAKNTEYLEMNNLKPEDTAVYYCTAQGQWR AAPVAVAAEYEFWGQGTQVTVSSGGGGSGGGGSEVQLVESGGGLVWPGGSLRLSCAATGFTLENKAIGWFRQTPGSER EGVLCISKSGSWTYYTDSMRGRFTISRDNAENTVYLQMDSLKPEDTAVYYCATTTAGGGLCWDGTTFSRLASSWGQGT QVTVSS |
| MD2304 (47) | EVQLVESGGGLVWPGGSLRLSCAATGFTLENKAIGWFRQTPGSEREGVLCISKSGSWTYYTDSMRGRFTISRDNAENT VYLQMDSLKPEDTAVYYCATTTAGGGLCWDGTTFSRLASSWGQGTQVTVSSGGGGSGGGGSEVQLVESGGGLVQPGGS LRLSCAVSISIFDIYAMDWYRQAPGKQRDLVATSFRDGSTNYADSVKGRFTISRDNAKNTLYLQMNSLKPEDTAVYLC HVSLYRDPLGVAGGMGVYWGKGALVTVSSGGGGSGGGGSEVQLVESGGGLVQPGGSLRLSCAVSISIFDIYAMDWYRQ APGKQRDLVATSFRDGSTNYADSVKGRFTISRDNAKNTLYLQMNSLKPEDTAVYLCHVSLYRDPLGVAGGMGVYWGKG ALVTVSS |
| MD2305 (48) | EVQLVESGGGLVWPGGSLRLSCAVSISIFDIYAMDWYRQAPGKQRDLVATSFRDGSTNYADSVKGRFTISRDNAKNTL YLQMNSLKPEDTAVYLCHVSLYRDPLGVAGGMGVYWGKGALVTVSSGGGGSGGGGSEVQLVESGGGLVQPGGSLRLSC AATGFTLENKAIGWFRQTPGSEREGVLCISKSGSWTYYTDSMRGRFTISRDNAENTVYLQMDSLKPEDTAVYYCATTT AGGGLCWDGTTFSRLASSWGQGTQVTVSSGGGGSGGGGSEVQLVESGGGLVQPGGSLRLSCAVSISIFDIYAMDWYRQ APGKQRDLVATSFRDGSTNYADSVKGRFTISRDNAKNTLYLQMNSLKPEDTAVYLCHVSLYRDPLGVAGGMGVYWGKG ALVTVSS |
| MD2306 (49) | EVQLVESGGGLVWPGGSLRLSCAVSISIFDIYAMDWYRQAPGKQRDLVATSFRDGSTNYADSVKGRFTISRDNAKNTL YLQMNSLKPEDTAVYLCHVSLYRDPLGVAGGMGVYWGKGALVTVSSGGGGSGGGGSEVQLVESGGGLVQPGGSLRLSC AVSISIFDIYAMDWYRQAPGKQRDLVATSFRDGSTNYADSVKGRFTISRDNAKNTLYLQMNSLKPEDTAVYLCHVSLY RDPLGVAGGMGVYWGKGALVTVSSGGGGSGGGGSEVQLVESGGGLVWPGGSLRLSCAATGFTLENKAIGWFRQTPGSE REGVLCISKSGSWTYYTDSMRGRFTISRDNAENTVYLQMDSLKPEDTAVYYCATTTAGGGLCWDGTTFSRLASSWGQG TQVTVSS |
| MD2307 (50) | EVQLVESGGGLVWPGGSLRLSCAATGFTLENKAIGWFRQTPGSEREGVLCISKSGSWTYYTDSMRGRFTISRDNAENT VYLQMDSLKPEDTAVYYCATTTAGGGLCWDGTTFSRLASSWGQGTQVTVSSGGGGSGGGGSEVQLVESGGGLVQAGDS LRISCAASGRTLSIYSMGWFRQAPGKEREFVATIGWNSGRTFYPDSLKGRFTISRDNARNTLYLQMNNLRPEDTAVYY CAAAKGPLRLSSQADYWGQGTQVTVSSGGGGSGGGGSEVQLVESGGGLVQAGDSLRLSCAASGPTFGMSAMGWFRQAP GKEREFVAAISGLGNPNYSDDVKGRFTISRENGRNTVYLQMNSLKPEDTAVYYCAQRKVYHVQGGDRPQAYDYWGQGT QVTVSS |
| MD2308 (51) | EVQLVESGGGLVQAGDSLRISCAASGRTLSIYSMGWFRQAPGKEREFVATIGWNSGRTFYPDSLKGRFTISRDNARNT LYLQMNNLRPEDTAVYYCAAAKGPLRLSSQADYWGQGTQVTVSSGGGGSGGGGSEVQLVESGGGLVWPGGSLRLSCAA TGFTLENKAIGWFRQTPGSEREGVLCISKSGSWTYYTDSMRGRFTISRDNAENTVYLQMDSLKPEDTAVYYCATTTAG |

TABLE 23-continued

Sequences of trimeric multi-domain antibody constructs.

| Construct (SEQ ID NO:) | Sequence |
|---|---|
|  | GGLCWDGTTFSRLASSWGQGTQVTVSSGGGGSGGGGSEVQLVESGGGLVQAGDSLRLSCAASGPTFGMSAMGWFRQAPGKEREFVAAISGLGNPNYSDDVKGRFTISRENGRNTVYLQMNSLKPEDTAVYYCAQRKVYHVQGGDRPQAYDYWGQGTQVTVSS |
| MD2309 (52) | EVQLVESGGGLVQAGDSLRISCAASGRTLSIYSMGWFRQAPGKEREFVATIGWNSGRTFYPDSLKGRFTISRDNARNTLYLQMNNLRPEDTAVYYCAAAKGPLRLSSQADYWGQGTQVTVSSGGGGSGGGGSEVQLVESGGGLVQAGDSLRLSCAASGPTFGMSAMGWFRQAPGKEREFVAAISGLGNPNYSDDVKGRFTISRENGRNTVYLQMNSLKPEDTAVYYCAQRKVYHVQGGDRPQAYDYWGQGTQVTVSSGGGGSGGGGSEVQLVESGGGLVWPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSS |
| MD2310 (53) | EVQLVESGGGLVWPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSSGGGGSGGGGSEVQLVESGGGLVQAGDSLRLSCAASGPTFGMSAMGWFRQAPGKEREFVAAISGLGNPNYSDDVKGRFTISRENGRNTVYLQMNSLKPEDTAVYYCAQRKVYHVQGGDRPQAYDYWGQGTQVTVSSGGGGSGGGGSEVQLVESGGGLVQAGDSLRISCAASGRTLSIYSMGWFRQAPGKEREFVATIGWNSGRTFYPDSLKGRFTISRDNARNTLYLQMNNLRPEDTAVYYCAAAKGPLRLSSQADYWGQGTQVTVSS |
| MD2311 (54) | EVQLVESGGGLVQAGDSLRLSCAASGPTFGMSAMGWFRQAPGKEREFVAAISGLGNPNYSDDVKGRFTISRENGRNTVYLQMNSLKPEDTAVYYCAQRKVYHVQGGDRPQAYDYWGQGTQVTVSSGGGGSGGGGSEVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSSGGGGSGGGGSEVQLVESGGGLVQAGDSLRISCAASGRTLSIYSMGWFRQAPGKEREFVATIGWNSGRTFYPDSLKGRFTISRDNARNTLYLQMNNLRPEDTAVYYCAAAKGPLRLSSQADYWGQGTQVTVSS |
| MD2312 (55) | EVQLVESGGGLVQAGDSLRLSCAASGPTFGMSAMGWFRQAPGKEREFVAAISGLGNPNYSDDVKGRFTISRENGRNTVYLQMNSLKPEDTAVYYCAQRKVYHVQGGDRPQAYDYWGQGTQVTVSSGGGGSGGGGSEVQLVESGGGLVQAGDSLRISCAASGRTLSIYSMGWFRQAPGKEREFVATIGWNSGRTFYPDSLKGRFTISRDNARNTLYLQMNNLRPEDTAVYYCAAAKGPLRLSSQADYWGQGTQVTVSSGGGGSGGGGSEVQLVESGGGLVWPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSS |
| MD2313 (56) | EVQLVESGGGLVQAGDSLRISCAASGRTLSIYSMGWFRQAPGKEREFVATIGWNSGRTFYPDSLKGRFTISRDNARNTLYLQMNNLRPEDTAVYYCAAAKGPLRLSSQADYWGQGTQVTVSSGGGGSGGGGSEVQLVESGGGLVQAGDSLRISCAASGRTLSIYSMGWFRQAPGKEREFVATIGWNSGRTFYPDSLKGRFTISRDNARNTLYLQMNNLRPEDTAVYYCAAAKGPLRLSSQADYWGQGTQVTVSSGGGGSGGGGSEVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSS |
| MD2314 (57) | EVQLVESGGGLVQAGDSLRLSCAASGPTFGMSAMGWFRQAPGKEREFVAAISGLGNPNYSDDVKGRFTISRENGRNTVYLQMNSLKPEDTAVYYCAQRKVYHVQGGDRPQAYDYWGQGTQVTVSSGGGGSGGGGSEVQLVESGGGLVQAGDSLRLSCAASGPTFGMSAMGWFRQAPGKEREFVAAISGLGNPNYSDDVKGRFTISRENGRNTVYLQMNSLKPEDTAVYYCAQRKVYHVQGGDRPQAYDYWGQGTQVTVSSGGGGSGGGGSEVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSS |
| MD2317 (58) | EVQLVESGGGLVWPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVQAGDSLRISCAASGRTLSIYSMGWFRQAPGKEREFVATIGWNSGRTFYPDSLKGRFTISRDNARNTLYLQMNNLRPEDTAVYYCAAAKGPLRLSSQADYWGQGTQVTVSSGGGGSGGGGSEVQLVESGGGLVWPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSS |
| MD2320 (59) | EVQLVESGGGLVQAGDSLRISCAASGRTLSIYSMGWFRQAPGKEREFVATIGWNSGRTFYPDSLKGRFTISRDNARNTLYLQMNNLRPEDTAVYYCAAAKGPLRLSSQADYWGQGTQVTVSSGGGGSGGGGSEVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVWPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSS |
| MD2322 (60) | EVQLVESGGGLVWPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSS |

TABLE 24

Sequences of tetrameric and pentameric multi-domain antibody constructs.

| Construct (SEQ ID NO:) | Sequence |
|---|---|
| MD2401 (61) | EVQLVESGGGLVWPGGSLRLSCAVSISIFDIYAMDWYRQAPGKQRDLVATSFRDGSTNYADSVKGRFTISRDNAKN TLYLQMNSLKPEDTAVYLCHVSLYRDPLGVAGGMGVYWGKGALVTVSSAAAGGGGSGGGGSGGGGSGGGGSGGGGS GGGGSGGGGSEVQLVESGGGLVQAGGSLKLSCAASGRTYAMGWFRQAPGKEREEVAHINALGTRTYYSDSVKGRFT ISRDNAKNTEYLEMNNLKPEDTAVYYCTAQGQWRAAPVAVAAEYEFWGQGTQVTVSSLINLEGGGGSGGGGSGGGG SGGGGSGGGGSGGGGSGGGGSPAGEVQLVESGGGLVQPGGSLRLSCAATGFTLENKAIGWFRQTPGSEREGVLCIS KSGSWTYYTDSMRGRFTISRDNAENTVYLQMDSLKPEDTAVYYCATTTAGGGLCWDGTTFSRLASSWGQGTQVTVS SAAAGGGGSGGGGSGGGGSGGGGSGGGGSGGGGSGGGGSEVQLVESGGGLVWPGGSLRLSCAATGFTLENKAIGWF RQTPGSEREGVLCISKSGSWTYYTDSMRGRFTISRDNAENTVYLQMDSLKPEDTAVYYCATTTAGGGLCWDGTTFS RLASSWGWGTQVTVSS |
| MD2402 (62) | EVQLVESGGGLVWPGGSLRLSCAVSISIFDIYAMDWYRQAPGKQRDLVATSFRDGSTNYADSVKGRFTISRDNAKN TLYLQMNSLKPEDTAVYLCHVSLYRDPLGVAGGMGVYWGKGALVTVSSAAAGGGGSGGGGSGGGGSGGGGSGGGGS GGGGSGGGGSEVQLVESGGGLVQAGGSLKLSCAASGRTYAMGWFRQAPGKEREEVAHINALGTRTYYSDSVKGRFT ISRDNAKNTEYLEMNNLKPEDTAVYYCTAQGQWRAAPVAVAAEYEFWGQGTQVTVSSLINLEGGGGSGGGGSGGGG SGGGGSGGGGSGGGGSGGGGSPAGEVQLVESGGGLVQPGGSLRLSCAATGFTLENKAIGWFRQTPGSEREGVLCIS KSGSWTYYTDSMRGRFTISRDNAENTVYLQMDSLKPEDTAVYYCATTTAGGGLCWDGTTFSRLASSWGQGTQVTVS SAAAGGGGSGGGGSGGGGSGGGGSGGGGSGGGGSGGGGSEVQLVESGGGLVWPGGSLKLSCAASGFTFSTSWMYWL RQAPGKGLEWVSVINTDGGTYYADSVKDRFTISRDNAKDTLYLQMSSLKSEDTAVYYCAKDWGGPEPTRGQGTQVT VSS |
| MD2403 (63) | EVQLVESGGGLVWPGGSLRLSCAVSISIFDIYAMDWYRQAPGKQRDLVATSFRDGSTNYADSVKGRFTISRDNAKN TLYLQMNSLKPEDTAVYLCHVSLYRDPLGVAGGMGVYWGKGALVTVSSAAAGGGGSGGGGSGGGGSGGGGSGGGGS GGGGSGGGGSEVQLVESGGGLVQAGGSLKLSCAASGRTYAMGWFRQAPGKEREEVAHINALGTRTYYSDSVKGRFT ISRDNAKNTEYLEMNNLKPEDTAVYYCTAQGQWRAAPVAVAAEYEFWGQGTQVTVSSLINLEGGGGSGGGGSGGGG SGGGGSGGGGSGGGGSGGGGSPAGEVQLVESGGGLVWPGGSLKLSCAASGFTFSTSWMYWLRQAPGKGLEWVSVIN TDGGTYYADSVKDRFTISRDNAKDTLYLQMSSLKSEDTAVYYCAKDWGGPEPTRGQGTQVTVSSAAAGGGGSGGGG SGGGGSGGGGSGGGGSGGGGSGGGGSEVQLVESGGGLVQPGGSLRLSCAATGFTLENKAIGWFRQTPGSEREGVLC ISKSGSWTYYTDSMRGRFTISRDNAENTVYLQMDSLKPEDTAVYYCATTTAGGGLCWDGTTFSRLASSWGQGTQVT VSS |
| MD2404 (64) | EVQLVESGGGLVWPGGSLRLSCAVSISIFDIYAMDWYRQAPGKQRDLVATSFRDGSTNYADSVKGRFTISRDNAKN TLYLQMNSLKPEDTAVYLCHVSLYRDPLGVAGGMGVYWGKGALVTVSSAAAGGGGSGGGGSGGGGSGGGGSGGGGS GGGGSGGGGSEVQLVESGGGLVQAGGSLKLSCAASGRTYAMGWFRQAPGKEREEVAHINALGTRTYYSDSVKGRFT ISRDNAKNTEYLEMNNLKPEDTAVYYCTAQGQWRAAPVAVAAEYEFWGQGTQVTVSSLINLEGGGGSGGGGSGGGG SGGGGSGGGGSGGGGSGGGGSPAGEVQLVESGGGLVWPGGSLKLSCAASGFTFSTSWMYWLRQAPGKGLEWVSVIN TDGGTYYADSVKDRFTISRDNAKDTLYLQMSSLKSEDTAVYYCAKDWGGPEPTRGQGTQVTVSSAAAGGGGSGGGG SGGGGSGGGGSGGGGSGGGGSGGGGSEVQLVESGGGLVWPGGSLKLSCAASGFTFSTSWMYWLRQAPGKGLEWVSV INTDGGTYYADSVKDRFTISRDNAKDTLYLQMSSLKSEDTAVYYCAKDWGGPEPTRGQGTQVTVSS |
| MD2405 (65) | EVQLVESGGGLVWPGGSLRLSCAVSISIFDIYAMDWYRQAPGKQRDLVATSFRDGSTNYADSVKGRFTISRDNAKN TLYLQMNSLKPEDTAVYLCHVSLYRDPLGVAGGMGVYWGKGALVTVSSAAAGGGGSGGGGSGGGGSGGGGSGGGGS GGGGSGGGGSEVQLVESGGGLVWPGGSLRLSCAVSISIFDIYAMDWYRQAPGKQRDLVATSFRDGSTNYADSVKGR FTISRDNAKNTLYLQMNSLKPEDTAVYLCHVSLYRDPLGVAGGMGVYWGKGALVTVSSLINLEGGGGSGGGGSGGG GSGGGGSGGGGSGGGGSGGGGSPAGEVQLVESGGGLVWPGGSLKLSCAASGFTFSTSWMYWLRQAPGKGLEWVSVI NTDGGTYYADSVKDRFTISRDNAKDTLYLQMSSLKSEDTAVYYCAKDWGGPEPTRGQGTQVTVSSAAAGGGGSGGG GSGGGGSGGGGSGGGGSGGGGSGGGGSEVQLVESGGGLVWPGGSLKLSCAASGFTFSTSWMYWLRQAPGKGLEWVS VINTDGGTYYADSVKDRFTISRDNAKDTLYLQMSSLKSEDTAVYYCAKDWGGPEPTRGQGTQVTVSS |
| MD2406 (66) | EVQLVESGGGLVWPGGSLRLSCAVSISIFDIYAMDWYRQAPGKQRDLVATSFRDGSTNYADSVKGRFTISRDNAKN TLYLQMNSLKPEDTAVYLCHVSLYRDPLGVAGGMGVYWGKGALVTVSSGGGGSGGGGSEVQLVESGGGLVQPGGSL RLSCAVSISIFDIYAMDWYRQAPGKQRDLVATSFRDGSTNYADSVKGRFTISRDNAKNTLYLQMNSLKPEDTAVYL CHVSLYRDPLGVAGGMGVYWGKGALVTVSSGGGGSGGGGSEVQLVESGGGLVWPGGSLRLSCAVSISIFDIYAMDW YRQAPGKQRDLVATSFRDGSTNYADSVKGRFTISRDNAKNTLYLQMNSLKPEDTAVYLCHVSLYRDPLGVAGGMGV YWGKGALVTVSSGGGGSGGGGSEVQLVESGGGLVWPGGSLRLSCAVSISIFDIYAMDWYRQAPGKQRDLVATSFRD GSTNYADSVKGRFTISRDNAKNTLYLQMNSLKPEDTAVYLCHVSLYRDPLGVAGGMGVYWGKGALVTVSS |
| MD2407 (67) | EVQLVESGGGLVWPGGSLRLSCAVSISIFDIYAMDWYRQAPGKQRDLVATSFRDGSTNYADSVKGRFTISRDNAKN TLYLQMNSLKPEDTAVYLCHVSLYRDPLGVAGGMGVYWGKGALVTVSSGGGGSGGGGSEVQLVESGGGLVQAGGSL KLSCAASGRTYAMGWFRQAPGKEREFVAHINALGTRTYYSDSVKGRFTISRDNAKNTEYLEMNNLKPEDTAVYYCT AQGGQWRAAPVAVAAEYEFWGQGTQVTVSSGGGGSGGGGSEVQLVESGGGLVWPGGSLRLSCAATGFTLENKAIGWF RQTPGSEREGVLCISKSGSWTYYTDSMRGRFTISRDNAENTVYLQMDSLKPEDTAVYYCATTTAGGGLCWDGTTFS RLASSWGQGTQVTVSSGGGGSGGGGSEVQLVESGGGLVQPGGSLKLSCAASGFTFSTSWMYWLRQAPGKGLEWVSV INTDGGTYYADSVKDRFTISRDNAKDTLYLQMSSLKSEDTAVYYCAKDWGGPEPTRGQGTQVTVSS |
| MD3401 (68) | EVQLVESGGGLVWPGGSLRLSCAVSISIFDIYAMDWYRQAPGKQRDLVATSFRDGSTNYADSVKGRFTISRDNAKN TLYLQMNSLKPEDTAVYLCHVSLYRDPLGVAGGMGVYWGKGALVTVSSGGGGSGGGGSEVQLVESGGGLVQPGGSL RLSCAVSISIFDIYAMDWYRQAPGKQRDLVATSFRDGSTNYADSVKGRFTISRDNAKNTLYLQMNSLKPEDTAVYL CHVSLYRDPLGVAGGMGVYWGKGALVTVSSGGGGSGGGGSEVQLVESGGGLVQPGGSLRLSCAATGFTLENKAIGW FRQTPGSEREGVLCISKSGSWTYYTDSMRGRFTISRDNAENTVYLQMDSLKPEDTAVYYCATTTAGGGLCWDGTTF SRLASSWGQGTQVTVSSGGGGSGGGGSEVQLVESGGGLVWPGGSLKLSCAASGFTFSTSWMYWLRQAPGKGLEWVS VINTDGGTYYADSVKDRFTISRDNAKDTLYLQMSSLKSEDTAVYYCAKDWGGPEPTRGQGTQVTVSS |
| MD3402 (69) | EVQLVESGGGLVWPGGSLRLSCAVSISIFDIYAMDWYRQAPGKQRDLVATSFRDGSTNYADSVKGRFTISRDNAKN TLYLQMNSLKPEDTAVYLCHVSLYRDPLGVAGGMGVYWGKGALVTVSSGGGGSGGGGSEVQLVESGGGLVQAGDSL RISCAASGRTLSIYSMGWFRQAPGKEREFVATIGWNSGRTFYPDSLKGRFTISRDNARNTLYLQMNNLRPEDTAVY |

TABLE 24-continued

Sequences of tetrameric and pentameric multi-domain antibody constructs.

| Construct (SEQ ID NO:) | Sequence |
|---|---|
|  | YCAAAKGPLRLSSQADYWGQGTQVTVSSGGGGSGGGGSEVQLVESGGGLVWPGGSLRLSCAATGFTLENKAIGWFR QTPGSEREGVLCISKSGSWTYYTDSMRGRFTISRDNAENTVYLQMDSLKPEDTAVYYCATTTAGGGLCWDGTTFSR LASSWGQGTQVTVSSGGGGSGGGGSEVQLVESGGGLVWPGGSLKLSCAASGFTFSTSWMYWLRQAPGKGLEWVSVI NTDGGTYYADSVKDRFTISRDNAKDTLYLQMSSLKSEDTAVYYCAKDWGGPEPTRGQGTQVTVSS |
| MD3403 (70) | EVQLVESGGGLVQAGDSLRLSCAASGPTFGMSAMGWFRQAPGKEREFVAAISGLGNPNYADDVKGRFTISREDGRN TVYLQMNSLKPEDTAVYYCAQRKVYHVQGGDRPQAYDYWGQGTQVTVSSGGGGSGGGGSEVQLVESGGGLVQAGGS LKLSCAASGRTYAMGWFRQAPGKEREFVAHINALGTRTYYSDSVKGRFTISRDNAKNTEYLEMNNLKPEDTAVYYC TAQGQWRAAPVAVAAEYEFWGQGTQVTVSSGGGGSGGGGSEVQLVESGGGLVQPGGSLRLSCAATGFTLENKAIGW FRQTPGSEREGVLCISKSGSWTYYTDSMRGRFTISRDNAENTVYLQMDSLKPEDTAVYYCATTTAGGGLCWDGTTF SRLASSWGQGTQVTVSSGGGGSGGGGSEVQLVESGGGLVWPGGSLKLSCAASGFTFSTSWMYWLRQAPGKGLEWVS VINTDGGTYYADSVKDRFTISRDNAKDTLYLQMSSLKSEDTAVYYCAKDWGGPEPTRGQGTQVTVSS |
| MD3404 (71) | EVQLVESGGGLVWPGGSLRLSCAVSISIFDIYAMDWYRQAPGKQRDLVATSFRDGSTNYADSVKGRFTISRDNAKN TLYLQMNSLKPEDTAVYLCHVSLYRDPLGVAGGMGVYWGKGALVTVSSGGGGSGGGGSEVQLVESGGGLVQAGGSL KLSCAASGRTYAMGWFRQAPGKEREFVAHINALGTRTYYSDSVKGRFTISRDNAKNTEYLEMNNLKPEDTAVYYCT AQGQWRAAPVAVAAEYEFWGQGTQVTVSSGGGGSGGGGSEVQLVESGGGLVQPGGSLRLSCVISGLSLDTYAVGWF RQAPGKEREGITCISSGHGMTYYADSVKGRFTVSTDNAKNTVYLQMNGLWPEDTARYYCATESRYYCSDNWPAPQR YIYWGQGTQVTVSSGGGGSGGGGSEVQLVESGGGLVWPGGSLKLSCAASGFTFSTSWMYWLRQAPGKGLEWVSVIN TDGGTYYADSVKDRFTISRDNAKDTLYLQMSSLKSEDTAVYYCAKDWGGPEPTRGQGTQVTVSS |
| MD3405 (72) | EVQLVESGGGLVWPGGSLRLSCAVSISIFDIYAMDWYRQAPGKQRDLVATSFRDGSTNYADSVKGRFTISRDNAKN TLYLQMNSLKPEDTAVYLCHVSLYRDPLGVAGGMGVYWGKGALVTVSSGGGGSGGGGSEVQLVESGGGLVQAGGSL KLSCAASGRTYAMGWFRQAPGKEREFVAHINALGTRTYYSDSVKGRFTISRDNAKNTEYLEMNNLKPEDTAVYYCT AQGQWRAAPVAVAAEYEFWGQGTQVTVSSGGGGSGGGGSEVQLVESGGGLVQAGGSLRLSCATSGQTFSSYAMGWF RQAPGKEREFVAAISWNGGSTYYADSVKGRFTISRESPENLVYLQMNSLKPEDTAVYYCAARGAYYTGSYYLGSTY DYWGQGTQVTVSSGGGGSGGGGSEVQLVESGGGLVWPGGSLKLSCAASGFTFSTSWMYWLRQAPGKGLEWVSVINT DGGTYYADSVKDRFTISRDNAKDTLYLQMSSLKSEDTAVYYCAKDWGGPEPTRGQGTQVTVSS |
| MD2501 (73) | EVQLVESGGGLVWPGGSLRLSCAVSISIFDIYAMDWYRQAPGKQRDLVATSFRDGSTNYADSVKGRFTISRDNAKN TLYLQMNSLKPEDTAVYLCHVSLYRDPLGVAGGMGVYWGKGALVTVSSGGGGSGGGGSEVQLVESGGGLVQPGGSL RLSCAVSISIFDIYAMDWYRQAPGKQRDLVATSFRDGSTNYADSVKGRFTISRDNAKNTLYLQMNSLKPEDTAVYL CHVSLYRDPLGVAGGMGVYWGKGALVTVSSGGGGSGGGGSEVQLVESGGGLVQAGGSLKLSCAASGRTYAMGWFRQ APGKEREFVAHINALGTRTYYSDSVKGRFTISRDNAKNTEYLEMNNLKPEDTAVYYCTAQGQWRAAPVAVAAEYEF WGQGTQVTVSSGGGGSGGGGSEVQLVESGGGLVQPGGSLRLSCAATGFTLENKAIGWFRQTPGSEREGVLCISKSG SWTYYTDSMRGRFTISRDNAENTVYLQMDSLKPEDTAVYYCATTTAGGGLCWDGTTFSRLASSWGQGTQVTVSSGG GGSGGGGSEVQLVESGGGLVWPGGSLKLSCAASGFTFSTSWMYWLRQAPGKGLEWVSVINTDGGTYYADSVKDRFT ISRDNAKDTLYLQMSSLKSEDTAVYYCAKDWGGPEPTRGQGTQVTVSS |

Influenza Neutralization by Multi-Domain Antibodies

Purified multi-domain antibodies were tested in influenza virus neutralization assays as described in Example 6 and showed improved potency and breadth when compared to sdAb building blocks. Results are shown for influenza neutralizing trimers in Table 25 and for tetramers and pentamers in Table 26.

TABLE 25

Average neutralization titers (nM) of trimeric multi-domain antibody constructs (empty cells mean 'not tested').

| Construct | H1N1 | | H5N1 | H2N2 | H3N2 | | | H7N3 A/ NIBRG/ 60 | H7N7 | H7N9 | B |
|---|---|---|---|---|---|---|---|---|---|---|---|
|  | A/New Caledonia/ 20/99 | A/ Puerto Rico/ 8/34-MA | A/ Vietnam/ 1194/ 04 | A/ Guiyang/ 1/57 | A/ WF/HK/ MPU3156/ 05 | A/ Brisbane/ 10/07 | A/ Wisconsin/ 67/05 | (A/ mallard/ NL/ 12/00) | A/PR8 H7N7- NY | A/ Anhui/ 1/13 | B/ Florida/ 04/06 |
| MD2301 | 14.7 |  |  |  |  |  | 34.7 |  |  |  | 412.3 |
| MD2302 | 14.7 |  |  |  |  |  | 34.7 |  |  |  | 412.3 |
| MD2303 | 7.2 | 9.1 | 9.1 |  |  | 12.8 | 15.0 | 10.2 | 18.2 |  | 412.3 |
| MD2304 | 20.6 |  |  |  |  |  | 18.2 |  |  |  |  |
| MD2305 | 4.3 |  |  |  |  |  | 21.7 |  |  |  |  |
| MD2306 | 6.1 |  | 4.7 |  |  | 10.7 | 5.4 | 15.4 |  |  |  |
| MD2307 |  |  | 21.6 |  |  | 30.4 |  | 18.1 |  |  |  |
| MD2308 |  |  | 21.6 |  |  | 15.3 |  | 12.8 |  |  |  |
| MD2309 |  |  | 12.8 |  |  | 12.8 |  | 9.1 |  |  |  |

TABLE 25-continued

Average neutralization titers (nM) of trimeric multi-domain antibody constructs (empty cells mean 'not tested').

| | H1N1 | | H5N1 | | H3N2 | | | H7N3 A/ NIBRG/ 60 | | | |
|---|---|---|---|---|---|---|---|---|---|---|---|
| Construct | A/New Caledonia/ 20/99 | A/ Puerto Rico/ 8/34-MA | A/ Vietnam/ 1194/ 04 | H2N2 A/ Guiyang/ 1/57 | A/ WF/HK/ MPU3156/ 05 | A/ Brisbane/ 10/07 | A/ Wisconsin/ 67/05 | (A/ mallard/ NL/ 12/00) | H7N7 A/PR8 H7N7-NY | H7N9 A/ Anhui/ 1/13 | B B/ Florida/ 04/06 |
| MD2310 | | | 21.6 | | | 25.5 | | 30.4 | | | |
| MD2311 | | | 12.8 | | | 21.6 | | 15.3 | | | |
| MD2312 | | | 5.8 | <1000 | 21.6 | 18.1 | | 7.7 | | 43.2 | |
| MD2313 | | | >1000 | | | 7.7 | | 6.5 | | 21.7 | |
| MD2314 | | | 6.5 | | | >1000 | | >1000 | | | |
| MD2317 | | | | | | | 12.8 | 12.8 | 12.8 | | |
| MD2320 | | | | | | | >1000 | 15.3 | 15.3 | | |
| MD2322 | | | | | | | 7.3 | 6.1 | 14.7 | | |

TABLE 26

Average neutralization titers (nM) of tetrameric and pentameric multi-domain antibody constructs (empty cells mean 'not tested').

| Type | Virus strain | MD2401 | MD2402 | MD2404 | MD2406 | MD2407 | MD2408 | MD2409 | MD2410 | MD2411 | MD2412 | MD2413 | MD2501 |
|---|---|---|---|---|---|---|---|---|---|---|---|---|---|
| H1N1 | A/California/07/09 | | | | | 3.4 | | | | | | | 3.0 |
| H1N1 | A/New Caledonia/20/99 | 14.7 | | | | 5.7 | | | | | | | 4.8 |
| H1N1 | A/Puerto Rico/8/34-MA | | | | | 7.3 | | | | | | | 8.5 |
| H1N1 | A/Brisbane/59/07 | | | | | 3.7 | | | | | | | 3.0 |
| H1N1 | A/Mississippi/03/01 274H | | | | | 4.8 | | | | | | | 4.9 |
| H1N1 | A/Solomon Islands/3/2006 (IVR 145) | | | | | 5.4 | | | | | | | 3.9 |
| H1N1 | A/WSN/33 | | | | | 4.8 | | | | | | | 2.9 |
| H1N1 | A/HK/54/98 | | | | | 10.3 | | | | | | | |
| H1N2 | A/Christchurch/16/10 | | | | | 1.3 | | | | | | | 1.3 |
| H1N2 | A/Env/HK/MPU3156/05 | | 12.8 | | | 25.6 | | | | | | | |
| H5N1 | A/PR8 H5N1 HK97 | | | | | 3.6 | | | | | | | |
| H5N1 | A/Vietnam/1194/04 | 27.7 | 23.8 | | | 9.2 | | | | | | | 4.9 |
| H5N1 | A/Indonesia/5/05 | | | 20.4 | | 16.2 | | | | | | | 6.5 |
| H5N1 | A/Eurasian Wigeon/MPF461/07 | | | | | 16.6 | | | | | | | |
| H5N2 | A/Eurasian Wigeon/HK/MPF333/07 | | | | | 26.0 | | | | | | | |
| H2N2 | A/Guiyang/1/57 | | | | | 125.6 | | | | | | | |
| 2N2 | A/AnnArbor/23/57 | | | | | 101.2 | | | | | | | |
| 2N2 | A/Env/HK/MPU3156/05 | | | | | 19.2 | | | | | | | 19.9 |
| H6N1 | A/Eurasian Wigeon/MPG1884/09 | | | | | 20.6 | | | | | | | |
| H6N1 | A/Taiwan/2/2013 | | | | | 36.3 | | | | | | | |
| H6N8 | A/Eurasian Wigeon/MPD411/07 | | | | | 20.9 | | | | | | | 16.0 |
| H11N9 | A/Northern Pintail/MPC2085/07 | | | | | 34.5 | | | | | | | |
| H9N2 | A/Ck/HK/SSP176/09 | | | | | 23.0 | | | | | | | |
| H9N2 | A/Great Cormorant/MP2934/04 | | | | | 19.6 | | | | | | | 16.0 |
| H9N2 | A/HK/46419/09 | | | | | 53.9 | | | | | | | |
| H8N4 | A/Eurasian Wigeon/MPH571/08 | | | | | 15.1 | | | | | | | |
| H8N2 | A/Env/MP1258/09 | | | | | 8.8 | | | | | | | |
| H12N5 | A/EnvMPK659/09 | | | | | >1000 | | | | | | | |
| H3N2 | A/Brisbane/10/07 | 27.7 | | | | 10.6 | 6.8 | | | | | | 9.6 |
| H3N2 | A/HK/1/68-MA | | 28.3 | 57.7 | | 25.9 | | 13.6 | 19.2 | 6.8 | 11.5 | 9.7 | 19.0 |
| H3N2 | A/Panama/2007/99 | | | | | 14.9 | | | | | | | 18.1 |
| H3N2 | A/Wisconsin/67/05 | | | | 4.6 | 19.1 | | | | | | | 14.1 |
| H3N2 | A/Fukui/45/04 | | | | | 19.2 | | | | | | | 21.2 |
| H3N2 | A/Aichi/2/68 | | | | | 9.9 | | | | | | | 12.6 |
| H3N2 | A/Hiroshima/52/05 | | | | | 10.5 | | | | | | | 6.5 |
| H3N2 | A/Johannesburg/33/94 | | | | | 11.6 | | | | | | | 11.6 |
| H3N2 | A/Perth/16/09 | | | | | 8.1 | | | | | | | 5.7 |
| H3N2 | A/Victoria/210/09 | | | | | 6.5 | | | | | | | 5.8 |
| H3N2 | A/HK/1174/99 | | | | | 76.0 | | | | | | | |
| H3N | A/Env/MP193/09 | | | | | 24.5 | | | | | | | |

TABLE 26-continued

Average neutralization titers (nM) of tetrameric and pentameric multi-domain antibody constructs (empty cells mean 'not tested').

| Type | Virus strain | MD2401 | MD2402 | MD2404 | MD2406 | MD2407 | MD2408 | MD2409 | MD2410 | MD2411 | MD2412 | MD2413 | MD2501 |
|---|---|---|---|---|---|---|---|---|---|---|---|---|---|
| H4 | A/WF/HK/MPA892/06 | | | | | 6.8 | | | | | | | 3.9 |
| H4N1 | A/Northern Pintail/MPB1368/06 | | | | | 8.2 | | | | | | | |
| H4N6 | A/Great Cormorant/MPB1683/06 | | | | | 4.8 | | | | | | | |
| H14N5 | A/Mallard/Astrakhan/263/1982 | | | | | 19.2 | | | | | | | 15.6 |
| H7N3 | A/NIBRG/60 (A/mallard/Netherlands/12/00) | 27.7 | 33.6 | 34.3 | 4.6 | 13.8 | | | | | | | 13.8 |
| H7N7 | A/PR8 H7N7-NY | | | | 11.0 | 22.3 | 27.2 | 19.2 | 27.1 | 19.3 | 19.3 | 16.3 | 14.0 |
| H7N7 | A/Northern Shoveler/MPF518/08 | | | | | 36.1 | | | | | | | |
| H7N7 | A/Netherlands/219/2003 | | | | | 33.0 | | | | | | | |
| H7N7 | A/Common Teal/MPF139/07 | | | | | 57.4 | | | | | | | |
| H7N9 | A/Anhui/1/13 | | | | | 64.6 | | | | | | | 73.8 |
| H7N9 | A/Shanghai/1/13 (R292K Tamiflu escape mutant) | | | | | 87.1 | | | | | | | 63.0 |
| H7N9 | A/Shanghai/2/13 | | | | | 54.2 | | | | | | | 36.5 |
| H10N7 | A/Chick/Germany/N/49 | | | | | 13.2 | | | | | | | 14.9 |
| H10N8 | A/Jiangxi/346/2013 | | | | | 30.4 | | | | | | | |
| H10N3 | A/Common Teal/MPH11/08 | | | | | 19.3 | | | | | | | |
| H10N9 | A/Northern Shoveler/MPE2531/08 | | | | | 35.0 | | | | | | | |
| Victoria | B/Brisbane/60/08 | | | | | 4.1 | 27.2 | 64.6 | 22.8 | 38.6 | 38.6 | 19.3 | 5.0 |
| Victoria | B/Malaysia/2506/04 | 277.1 | 14.1 | | | 9.2 | 38.4 | 38.4 | 38.3 | 38.6 | 38.6 | 38.7 | 8.8 |
| Yamagata | B/Florida/04/06 | | | | | 7.6 | 64.6 | 108.7 | 91.2 | 38.6 | 38.6 | 38.7 | 8.3 |
| Yamagata | B/Harbin/7/94 | | | 2.1 | | 6.4 | 27.2 | 64.6 | 19.2 | 22.9 | 38.6 | 19.3 | 4.3 |
| Yamagata | B/Massachusetts/02/12 | | | | | 3.0 | | | | | | | 4.0 |
| Old | B/Lee/40 | 164.8 | 35.4 | 30.3 | | 18.4 | 32.3 | 38.4 | 19.2 | 38.6 | 45.9 | 38.7 | 14.6 |

Multi-Domain Antibody Binding to HA

Label free biolayer interferometry was also used to determine the equilibrium dissociation constants ($K_D$ values) as measure of the binding potencies between the multi-domain antibodies and recombinant HA molecules of different Influenza strains at pH 7.4. The $K_D$ values were determined by fitting the binding responses of a MD concentration range at steady state (average binding response of the last 10 seconds measured in the plateau of the association phase) to obtain the concentration at 50% of the saturation, which reflects the $K_D$ value ($R=R_{max}*[dAb]/(K_D+[sdAb])$). Serial dilutions were measured in duplicate and geometric mean $K_D$ values are reported in Table 27.

TABLE 27

Geometric mean $K_D$ values (nM) of multi-domain antibody constructs binding to HA at pH 7.4 (empty cells mean 'not tested').

| | H1N1 A/ Brisbane/ 59/07 | H3N2 A/HK/1/ 68-MA | H3N2 A/ Wisconsin/ 67/05 | H7N3 A/NIBRG/60 (A/mallard/ NL/12/00) | H7N9 A/ Hangzhou/ 1/2013 | Victoria B/ Brisbane/ 60/08 | Yamagata B/ Florida/ 04/06 |
|---|---|---|---|---|---|---|---|
| MD1221 | | | | | | 1.7 | 1.9 |
| MD2407 | 2.8 | 2.2 | 0.5 | 1.2 | 1.7 | 3.1 | |
| MD3606 | 2.2 | 1.4 | 0.6 | 1.1 | 1.2 | 3.8 | |

Inhibition of Conformational Change of HA by Stem Binding sdAbs

To prove that multi-domain antibodies containing HA stem binding sdAb building blocks, similarly to the antibodies they compete with, prevent the conformational change of HA and thereby block viral fusion and subsequent infection, an assay was performed as described in Example 6. Results are summarized in Table 29.

TABLE 29

Prevention of conformational change of HA by multi-domain antibodies.

| | H1N1 A/ Brisbane/ 59/07 | H3N2 A/HK/ 1/68 | H7N3 A/NIBRG/60 (A/mallard/ NL/12/00) | H7N9 A/ Hangzhou/ 1/2013 | Victoria B/Brisbane/ 60/08 |
|---|---|---|---|---|---|
| MD2407 | ++ | ++ | ++ | ++ | + |
| MD1221 | − | − | − | − | ++ |
| MD3606 | ++ | ++ | − | − | + |

'++' refers to strong and '+' to medium inhibition of conformational change of HA.
'−' refers to no inhibition.
Empty cells mean 'not tested'.

Linking 3 or more sdAbs together can significantly improve potency and breadth of neutralization compared to the individual building blocks. Thus, influenza strains which could not be neutralized by any of the sdAbs individually can reliably be neutralized by multimeric constructs of the same sdAbs. The combination of sdAbs neutralizing influenza A group 1, A group 2, or B resulted in multi-domains capable of neutralizing virtually all tested strains. The increase in breadth of neutralization is related to the underlying breadth of binding of used sdAbs. The increase in avidity for HA in addition to possible other neutralization mechanisms related to the bivalent nature of the constructs are thought to be responsible for the described improvements. Blocking of viral fusion as the mechanism of viral neutralization was confirmed for tested dimers and multi-domains.

Example 9: Generation and Characterization of Fc-Fusion Constructs

Generation of Fc-Fusion Constructs

SdAbs and sdAb multimers can be fused to the Fc region of antibodies. The Fc region is defined as part of an antibody, e.g. a human IgG1 molecule, containing the hinge region followed by the CH2 and CH3 domain. Different Fc fusion constructs have been generated and compared with sdAb multimers and monoclonal antibodies with regard to HA binding, in vitro neutralization and in vivo efficacy.

SdAbs or sdAb multimers were fused with or without additional linkers as shown in Table 15 to the C- and/or N-terminus of Fc fragments. The Fc-fusion constructs were expressed in mammalian cells and secreted into the medium as dimeric Fc molecules. Complete amino acid sequences of the Fc fusion constructs are shown in Table 30. The position of the sdAbs or sdAb multimers within constructs was varied to allow for the most optimal combination. Homodimeric as well as heterodimeric Fc-fusion molecules were generated. Heterodimeric Fc fusions were generated by introducing single point mutations in the CH3 domain as described by Labrijn et al. (2013). These mutations are K409R and F405L and the Fc chains containing these mutations are, respectively, referred to as FcGa and FcGb.

Fc-fusion constructs were expressed in suspension Expi293 cells. DNA constructs containing the sequences for heterodimeric Fc constructs with the K409R or F405L mutations were transfected as single vector containing the two sequential open reading frames. Transient transfection and expression were performed according to the supplier's instructions and were similar to previously reported conditions for the production of human IgG constructs (Dreyfus et al., 2012). Possible aggregates and impurities were removed by preparative gel filtration (Superdex 75 pg or Superdex 200 pg column, GE Healthcare). Samples were analyzed on SDS-PAGE and fractions corresponding to the expected molecular weight were pooled and concentrated using Amicon Ultra 30K centrifugal filters. All production runs resulted in dimeric Fc fusion molecules that were stably linked by disulfide bridges in the hinge region. In case both FcGa and FcGb were transfected into the same cells the purified Fc fusion protein was subjected to controlled reducing conditions in vitro that separates the Fc-fusion into half-molecules and allow reassembly and reoxidation to form a pure heterodimeric Fc fusion molecule as described by Labrijn et al. (2013).

TABLE 30

Sequences of Fc-fusion constructs.

| Construct | Sequence | SEQ ID NO: |
|---|---|---|
| MD2605 | EVQLVESGGGLVQPGGSLRLSCAVSISIFDIYAMDWYRQAPGKQRDLVATSFRDGSTNYADSVKGRFTI SRDNAKNTLYLQMNSLKPEDTAVYLCHVSLYRDPLGVAGGMGVYWGKGALVTVSSAAADKTHTCPPCPA PELLGGPSVFLFPPKPKDTLMISRTPEVTCVVVDVSHEDPEVKFNWYVDGVEVHNAKTKPREEQYNSTY RVVSVLTVLHQDWLNGKEYKCKVSNKALPAPIEKTISKAKGQPREPQVYTLPPSREEMTKNQVSLTCLV KGFYPSDIAVEWESNGQPENNYKTTPPVLDSDGSFFLYSKLTVDKSRWQQGNVFSCSVMHEALHNHYTQ KSLSLSPGK | 74 |
| MD2606 | EVQLVESGGGLVQPGGSLRLSCAVSISIFDIYAMDWYRQAPGKQRDLVATSFRDGSTNYADSVKGRFTI SRDNAKNTLYLQMNSLKPEDTAVYLCHVSLYRDPLGVAGGMGVYWGKGALVTVSSGGGGSGGGGSAAAD KTHTCPPCPAPELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYTLPPSREEMT KNQVSLTCLVKGFYPSDIAVEWESNGWPENNYKTTPPVLDSDGSFFLYSKLTVDKSRWQQGNVFSCSVM HEALHNHYTQKSLSLSPGK | 75 |
| MD2607 | EVQLVESGGGLVQPGGSLRLSCAATGFTLENKAIGWFRQTPGSEREGVLCISKSGSWTYYTDSMRGRFT ISRDNAENTVYLQMDSLKPEDTAVYYCATTTAGGGLCWDGTTFSRLASSWGQGTQVTVSSAAADKTHTC PPCPAPELLGGPSVFLFPPKPKDTLMISRTPEVTCVVVDVSHEDPEVKFNWYVDGVEVHNAKTKPREEQ YNSTYRVVSVLTVLHQDWLNGKEYKCKVSNKALPAPIEKTISKAKGQPREPQVYTLPPSREEMTKNQVS LTCLVKGFYPSDIAVEWESNGQPENNYKTTPPVLDSDGSFFLYSKLTVDKSRWQQGNVFSCSVMHEALH NHYTQKSLSLSPGK | 76 |
| MD2608 | EVQLVESGGGLVQPGGSLRLSCAATGFTLENKAIGWFRQTPGSEREGVLCISKSGSWTYYTDSMRGRFT ISRDNAENTVYLQMDSLKPEDTAVYYCATTTAGGGLCWDGTTFSRLASSWGQGTQVTVSSGGGGSGGGG SAAADKTHTCPPCPAPELLGGPSVFLFPPKPKDTLMISRTPEVTCVVVDVSHEDPEVKFNWYVDGVEVH NAKTKPREEQYNSTYRVVSVLTVLHQDWLNGKEYKCKVSNKALPAPIEKTISKAKGQPREPQVYTLPPS REEMTKNQVSLTCLVKGFYPSDIAVEWESNGWPENNYKTTPPVLDSDGSFFLYSKLTVDKSRWQQGNVF SCSVMHEALHNHYTQKSLSLSPGK | 77 |
| MD2609 | EVQLVESGGGLVWPGGSLKLSCAASGFTFSTSWMYWLRQAPGKGLEWVSVINTDGGTYYADSVKDRFTI SRDNAKDTLYLQMSSLKSEDTAVYYCAKDWGGPEPTRGQGTQVTVSSAAADKTHTCPPCPAPELLGGPS VFLFPPKPKDTLMISRTPEVTCVVVDVSHEDPEVKFNWYVDGVEVHNAKTKPREEQYNSTYRVVSVLTV LHQDWLNGKEYKCKVSNKALPAPIEKTISKAKGWPREPQVYTLPPSREEMTKNQVSLTCLVKGFYPSDI AVEWESNGWPENNYKTTPPVLDSDGSFFLYSKLTVDKSRWQQGNVFSCSVMHEALHNHYTQKSLSLSPG K | 78 |
| MD2610 | EVQLVESGGGLVWPGGSLKLSCAASGFTFSTSWMYWLRQAPGKGLEWVSVINTDGGTYYADSVKDRFTI SRDNAKDTLYLQMSSLKSEDTAVYYCAKDWGGPEPTRGQGTQVTVSSGGGGSGGGGSAAADKTHTCPPC PAPELLGGPSVFLFPPKPKDTLMISRTPEVTCVVVDVSHEDPEVKFNWYVDGVEVHNAKTKPREEQYNS TYRVVSVLTVLHQDWLNGKEYKCKVSNKALPAPIEKTISKAKGQPREPQVYTLPPSREEMTKNQVSLTC LVKGFYPSDIAVEWESNGQPENNYKTTPPVLDSDGSFFLYSKLTVDKSRWQQGNVFSCSVMHEALHNHY TQKSLSLSPGK | 79 |
| MD2601 | EVQLVESGGGLVQPGGSLRLSCAVSISIFDIYAMDWYRQAPGKQRDLVATSFRDGSTNYADSVKGRFTI SRDNAKNTLYLQMNSLKPEDTAVYLCHVSLYRDPLGVAGGMGVYWGKGALVTVSSAAAGGGGSGGGGSG GGGSGGGGSGGGGSGGGGSGGGGSEVQLVESGGGLVWPGGSLRLSCAATGFTLENKAIGWFRQTPGSER EGVLCISKSGSWTYYTDSMRGRFTISRDNAENTVYLQMDSLKPEDTAVYYCATTTAGGGLCWDGTTFSR LASSWGQGTQVTVSSLINLEAAADKTHTCPPCPAPELLGGPSVFLFPPKPKDTLMISRTPEVTCVVVDV SHEDPEVKFNWYVDGVEVHNAKTKPREEQYNSTYRVVSVLTVLHQDWLNGKEYKCKVSNKALPAPIEKT ISKAKGWPREPQVYTLPPSREEMTKNQVSLTCLVKGFYPSDIAVEWESNGWPENNYKTTPPVLDSDGSF FLYSKLTVDKSRWWQGNVFSCSVMHEALHNHYTWKSLSLSPGK | 80 |
| MD2602 | EVQLVESGGGLVQPGGSLRLSCAVSISIFDIYAMDWYRQAPGKQRDLVATSFRDGSTNYADSVKGRFTI SRDNAKNTLYLQMNSLKPEDTAVYLCHVSLYRDPLGVAGGMGVYWGKGALVTVSSAAAGGGGSGGGGSG GGSGGGGSGGGGSGGGGSGGGGSEVQLVESGGGLVWPGGSLKLSCAASGFTFSTSWMYWLRQAPGKGL EWVSVINTDGGTYYADSVKDRFTISRDNAKDTLYLQMSSLKSEDTAVYYCAKDWGGPEPTRGQGTQVTV SSLINLEAAADKTHTCPPCPAPELLGGPSVFLFPPKPKDTLMISRTPEVTCVVVDVSHEDPEVKFNWYV DGVEVHNAKTKPREEQYNSTYRVVSVLTVLHQDWLNGKEYKCKVSNKALPAPIEKTISKAKGQPREPQV YTLPPSREEMTKNQVSLTCLVKGFYPSDIAVEWESNGQPENNYKTTPPVLDSDGSFFLYSKLTVDKSRW QQGNVFSCSVMHEALHNHYTQKSLSLSPGK | 81 |
| MD2603 | EVQLVESGGGLVQPGGSLRLSCAATGFTLENKAIGWFRQTPGSEREGVLCISKSGSWTYYTDSMRGRFT ISRDNAENTVYLQMDSLKPEDTAVYYCATTTAGGGLCWDGTTFSRLASSWGQGTQVTVSSAAAGGGGSG GGGSGGGGSGGGGSGGGGSGGGGSEVQLVESGGGLVQPGGSLRLSCAVSISIFDIYAMDWYRQA PGKQRDLVATSFRDGSTNYADSVKGRFTISRDNAKNTLYLQMNSLKPEDTAVYLCHVSLYRDPLGVAGG MGVYWGKGALVTVSSLINLEAAADKTHTCPPCPAPELLGGPSVFLFPPKPKDTLMISRTPEVTCVVVDV SHEDPEVKFNWYVDGVEVHNAKTKPREEQYNSTYRVVSVLTVLHQDWLNGKEYKCKVSNKALPAPIEKT ISKAKGWPREPQVYTLPPSREEMTKNQVSLTCLVKGFYPSDIAVEWESNGWPENNYKTTPPVLDSDGSF FLYSKLTVDKSRWWQGNVFSCSVMHEALHNHYTWKSLSLSPGK | 82 |
| MD2604 | EVQLVESGGGLVWPGGSLKLSCAASGFTFSTSWMYWLRQAPGKGLEWVSVINTDGGTYYADSVKDRFTI SRDNAKDTLYLQMSSLKSEDTAVYYCAKDWGGPEPTRGQGTQVTVSSAAAGGGGSGGGGSGGGGSGGGG SGGGGSGGGGSGGGGSEVQLVESGGGLVQPGGSLRLSCAVSISIFDIYAMDWYRQAPGKQRDLVATSFR DGSTNYADSVKGRFTISRDNAKNTLYLQMNSLKPEDTAVYLCHVSLYRDPLGVAGGMGVYWGKGALVTV SSLINLEAAADKTHTCPPCPAPELLGGPSVFLFPPKPKDTLMISRTPEVTCVVVDVSHEDPEVKFNWYV DGVEVHNAKTKPREEQYNSTYRVVSVLTVLHQDWLNGKEYKCKVSNKALPAPIEKTISKAKGQPREPQV | 83 |

TABLE 30-continued

Sequences of Fc-fusion constructs.

| Construct | Sequence | SEQ ID NO: |
|---|---|---|
| | YTLPPSREEMTKNQVSLTCLVKGFYPSDIAVEWESNGQPENNYKTTPPVLDSDGSFFLYSKLTVDKSRW<br>QQGNVFSCSVMHEALHNHYTQKSLSLSPGK | |
| MD2611 | EVQLVESGGGLVQPGGSLRLSCAVSISIFDIYAMDWYRQAPGKQRDLVATSFRDGSTNYADSVKGRFTI<br>SRDNAKNTLYLQMNSLKPEDTAVYLCHVSLYRDPLGVAGGMGVYWGKGALVTVSSGGGGSGGGGSEVQL<br>VESGGGLVWPGGSLRLSCAATGFTLENKAIGWFRQTPGSEREGVLCISKSGSWTYYTDSMRGRFTISRD<br>NAENTVYLQMDSLKPEDTAVYYCATTTAGGGLCWDGTTFSRLASSWGQGTQVTVSSAAADKTHTCPPCP<br>APELLGGPSVFLFPPKPKDTLMISRTPEVTCVVVDVSHEDPEVKFNWYVDGVEVHNAKTKPREEQYNST<br>YRVVSVLTVLHQDWLNGKEYKCKVSNKALPAPIEKTISKAKGQPREPQVYTLPPSREEMTKNQVSLTCL<br>VKGFYPSDIAVEWESNGQPENNYKTTPPVLDSDGSFFLYSKLTVDKSRWQQGNVFSCSVMHEALHNHYT<br>QKSLSLSPGK | 84 |
| MD2612 | EVQLVESGGGLVWPGGSLRLSCAATGFTLENKAIGWFRQTPGSEREGVLCISKSGSWTYYTDSMRGRFT<br>ISRDNAENTVYLQMDSLKPEDTAVYYCATTTAGGGLCWDGTTFSRLASSWGQGTQVTVSSGGGGSGGGG<br>SEVQLVESGGGLVQPGGSLRLSCAVSISIFDIYAMDWYRQAPGKQRDLVATSFRDGSTNYADSVKGRFT<br>ISRDNAKNTLYLQMNSLKPEDTAVYLCHVSLYRDPLGVAGGMGVYWGKGALVTVSSAAADKTHTCPPCP<br>APELLGGPSVFLFPPKPKDTLMISRTPEVTCVVVDVSHEDPEVKFNWYVDGVEVHNAKTKPREEQYNST<br>YRVVSVLTVLHQDWLNGKEYKCKVSNKALPAPIEKTISKAKGQPREPQVYTLPPSREEMTKNQVSLTCL<br>VKGFYPSDIAVEWESNGQPENNYKTTPPVLDSDGSFFLYSKLTVDKSRWQQGNVFSCSVMHEALHNHYT<br>QKSLSLSPGK | 85 |
| MD2613 | EVQLVESGGGLVWPGGSLKLSCAASGFTFSTSWMYWLRQAPGKGLEWVSVINTDGGTYYADSVKDRFTI<br>SRDNAKDTLYLQMSSLKSEDTAVYYCAKDWGGPEPTRGQGTQVTVSSGGGGSGGGGSEVQLVESGGGLV<br>QPGGSLRLSCAVSISIFDIYAMDWYRQAPGKQRDLVATSFRDGSTNYADSVKGRFTISRDNAKNTLYLQ<br>MNSLKPEDTAVYLCHVSLYRDPLGVAGGMGVYWGKGALVTVSSAAADKTHTCPPCPAPELLGGPSVFLF<br>PPKPKDTLMISRTPEVTCVVVDVSHEDPEVKFNWYVDGVEVHNAKTKPREEQYNSTYRVVSVLTVLHQD<br>WLNGKEYKCKVSNKALPAPIEKTISKAKGQPREPQVYTLPPSREEMTKNQVSLTCLVKGFYPSDIAVEW<br>ESNGQPENNYKTTPPVLDSDGSFFLYSKLTVDKSRWQQGNVFSCSVMHEALHNHYTQKSLSLSPGK | 86 |
| MD2614 | EVQLVESGGGLVQPGGSLRLSCAVSISIFDIYAMDWYRQAPGKQRDLVATSFRDGSTNYADSVKGRFTI<br>SRDNAKNTLYLQMNSLKPEDTAVYLCHVSLYRDPLGVAGGMGVYWGKGALVTVSSGGGGSGGGGSEVQL<br>VESGGGLVWPGGSLKLSCAASGFTFSTSWMYWLRQAPGKGLEWVSVINTDGGTYYADSVKDRFTISRDN<br>AKDTLYLQMSSLKSEDTAVYYCAKDWGGPEPTRGQGTQVTVSSAAADKTHTCPPCPAPELLGGPSVFLF<br>PPKPKDTLMISRTPEVTCVVVDVSHEDPEVKFNWYVDGVEVHNAKTKPREEQYNSTYRVVSVLTVLHQD<br>WLNGKEYKCKVSNKALPAPIEKTISKAKGQPREPQVYTLPPSREEMTKNQVSLTCLVKGFYPSDIAVEW<br>ESNGQPENNYKTTPPVLDSDGSFFLYSKLTVDKSRWQQGNVFSCSVMHEALHNHYTQKSLSLSPGK | 87 |
| MD2615 | EVQLVESGGGLVQPGGSLRLSCAVSISIFDIYAMDWYRQAPGKQRDLVATSFRDGSTNYADSVKGRFTI<br>SRDNAKNTLYLQMNSLKPEDTAVYLCHVSLYRDPLGVAGGMGVYWGKGALVTVSSAAADKTHTCPPCPA<br>PELLGGPSVFLFPPKPKDTLMISRTPEVTCVVVDVSHEDPEVKFNWYVDGVEVHNAKTKPREEQYNSTY<br>RVVSVLTVLHQDWLNGKEYKCKVSNKALPAPIEKTISKAKGQPREPQVYTLPPSREEMTKNQVSLTCLV<br>KGFYPSDIAVEWESNGQPENNYKTTPPVLDSDGSFFLYSKLTVDKSRWQQGNVFSCSVMHEALHNHYTQ<br>KSLSLSPGKGGGGSGGGGSEVQLVESGGGLVWPGGSLRLSCAATGFTLENKAIGWFRQTPGSEREGVLC<br>ISKSGSWTYYTDSMRGRFTISRDNAENTVYLQMDSLKPEDTAVYYCATTTAGGGLCWDGTTFSRLASSW<br>GWGTQVTVSS | 88 |
| MD2616 | EVQLVESGGGLVWPGGSLRLSCAATGFTLENKAIGWFRQTPGSEREGVLCISKSGSWTYYTDSMRGRFT<br>ISRDNAENTVYLQMDSLKPEDTAVYYCATTTAGGGLCWDGTTFSRLASSWGQGTQVTVSSAAADKTHTC<br>PPCPAPELLGGPSVFLFPPKPKDTLMISRTPEVTCVVVDVSHEDPEVKFNWYVDGVEVHNAKTKPREEQ<br>YNSTYRVVSVLTVLHQDWLNGKEYKCKVSNKALPAPIEKTISKAKGQPREPQVYTLPPSREEMTKNQVS<br>LTCLVKGFYPSDIAVEWESNGQPENNYKTTPPVLDSDGSFFLYSKLTVDKSRWQQGNVFSCSVMHEALH<br>NHYTQKSLSLSPGKGGGGSGGGGSEVQLVESGGGLVQPGGSLRLSCAVSISIFDIYAMDWYRQAPGKQR<br>DLVATSFRDGSTNYADSVKGRFTISRDNAKNTLYLQMNSLKPEDTAVYLCHVSLYRDPLGVAGGMGVYW<br>GKGALVTVSS | 89 |
| MD2617 | EVQLVESGGGLVQPGGSLRLSCAVSISIFDIYAMDWYRQAPGKQRDLVATSFRDGSTNYADSVKGRFTI<br>SRDNAKNTLYLQMNSLKPEDTAVYLCHVSLYRDPLGVAGGMGVYWGKGALVTVSSAAADKTHTCPPCPA<br>PELLGGPSVFLFPPKPKDTLMISRTPEVTCVVVDVSHEDPEVKFNWYVDGVEVHNAKTKPREEQYNSTY<br>RVVSVLTVLHQDWLNGKEYKCKVSNKALPAPIEKTISKAKGQPREPQVYTLPPSREEMTKNQVSLTCLV<br>KGFYPSDIAVEWESNGQPENNYKTTPPVLDSDGSFFLYSKLTVDKSRWQQGNVFSCSVMHEALHNHYTQ<br>KSLSLSPGKGGGGSGGGGSEVQLVESGGGLVWPGGSLKLSCAASGFTFSTSWMYWLRQAPGKGLEWVSV<br>INTDGGTYYADSVKDRFTISRDNAKDTLYLQMSSLKSEDTAVYYCAKDWGGPEPTRGQGTQVTVSS | 90 |
| MD2618 | EVQLVESGGGLVWPGGSLKLSCAASGFTFSTSWMYWLRQAPGKGLEWVSVINTDGGTYYADSVKDRFTI<br>SRDNAKDTLYLQMSSLKSEDTAVYYCAKDWGGPEPTRGQGTQVTVSSAAADKTHTCPPCPAPELLGGPS<br>VFLFPPKPKDTLMISRTPEVTCVVVDVSHEDPEVKFNWYVDGVEVHNAKTKPREEQYNSTYRVVSVLTV<br>LHQDWLNGKEYKCKVSNKALPAPIEKTISKAKGWPREPQVYTLPPSREEMTKNQVSLTCLVKGFYPSDI<br>AVEWESNGWPENNYKTTPPVLDSDGSFFLYSKLTVDKSRWQQGNVFSCSVMHEALHNHYTQKSLSLSPG<br>KGGGGSGGGGSEVQLVESGGGLVWPGGSLRLSCAVSISIFDIYAMDWYRQAPGKQRDLVATSFRDGSTN<br>YADSVKGRFTISRDNAKNTLYLQMNSLKPEDTAVYLCHVSLYRDPLGVAGGMGVYWGKGALVTVSS | 91 |
| MD2626 | EVQLVESGGGLVQPGGSLRLSCAVSISIFDIYAMDWYRQAPGKQRDLVATSFRDGSTNYADSVKGRFTI<br>SRDNAKNTLYLQMNSLKPEDTAVYLCHVSLYRDPLGVAGGMGVYWGKGALVTVSSAAADKTHTCPPCPA<br>PELLGGPSVFLFPPKPKDTLMISRTPEVTCVVVDVSHEDPEVKFNWYVDGVEVHNAKTKPREEQYNSTY<br>RVVSVLTVLHQDWLNGKEYKCKVSNKALPAPIEKTISKAKGQPREPQVYTLPPSREEMTKNQVSLTCLV | 92 |

TABLE 30-continued

Sequences of Fc-fusion constructs.

| Construct | Sequence | SEQ ID NO: |
|---|---|---|
| | KGFYPSDIAVEWESNGQPENNYKTTPPVLDSDGSFFLYSKLTVDKSRWQQGNVFSCSVMHEALHNHYTQ KSLSLSPGKGGGGSGGGGSGGGGSGGGGSGGGGSGGGGSEVQLVESGGGLVQPGGSLRLSCAATGFTLE NKAIGWFRQTPGSEREGVLCISKSGSWTYYTDSMRGRFTISRDNAENTVYLQMDSLKPEDTAVYYCATT TAGGGLCWDGTTFSRLASSWGQGTQVTVSS | |
| MD2619 | EVQLVESGGGLVQPGGSLRLSCAATGFTLENKAIGWFRQTPGSEREGVLCISKSGSWTYYTDSMRGRFT ISRDNAENTVYLQMDSLKPEDTAVYYCATTTAGGGLCWDGTTFSRLASSWGQGTQVTVSSGGGGSGGGG SEVQLVESGGGLVWPGGSLRLSCAVSISIFDIYAMDWYRQAPGKQRDLVATSFRDGSTNYADSVKGRFT ISRDNAKNTLYLQMNSLKPEDTAVYLCHVSLYRDPLGVAGGMGVYWGKGALVTVSSGGGGSGGGGSEVQ LVESGGGLVQAGGSLKLSCAASGRTYAMGWFRQAPGKEREFVAHINALGTRTYYSDSVKGRFTISRDNA KNTEYLEMNNLKPEDTAVYYCTAQGQWRAAPVAVAAEYEFWGQGTQVTVSSAAADKTHTCPPCPAPELL GGPSVFLFPPKPKDTLMISRTPEVTCVVVDVSHEDPEVKFNWYVDGVEVHNAKTKPREEQYNSTYRVVS VLTVLHQDWLNGKEYKCKVSNKALPAPIEKTISKAKGWPREPQVYTLPPSREEMTKNQVSLTCLVKGFY PSDIAVEWESNGQPENNYKTTPPVLDSDGSFFLYSKLTVDKSRWQQGNVFSCSVMHEALHNHYTQKSLS LSPGK | 93 |
| MD2620 | EVQLVESGGGLVQPGGSLRLSCAVSISIFDIYAMDWYRQAPGKQRDLVATSFRDGSTNYADSVKGRFTI SRDNAKNTLYLQMNSLKPEDTAVYLCHVSLYRDPLGVAGGMGVYWGKGALVTVSSGGGGSGGGGSEVQL VESGGGLVWPGGSLRLSCAATGFTLENKAIGWFRQTPGSEREGVLCISKSGSWTYYTDSMRGRFTISRD NAENTVYLQMDSLKPEDTAVYYCATTTAGGGLCWDGTTFSRLASSWGQGTQVTVSSGGGGSGGGGSEVQ LVESGGGLVQAGGSLKLSCAASGRTYAMGWFRQAPGKEREFVAHINALGTRTYYSDSVKGRFTISRDNA KNTEYLEMNNLKPEDTAVYYCTAQGQWRAAPVAVAAEYEFWGQGTQVTVSSAAADKTHTCPPCPAPELL GGPSVFLFPPKPKDTLMISRTPEVTCVVVDVSHEDPEVKFNWYVDGVEVHNAKTKPREEQYNSTYRVVS VLTVLHQDWLNGKEYKCKVSNKALPAPIEKTISKAKGWPREPQVYTLPPSREEMTKNQVSLTCLVKGFY PSDIAVEWESNGQPENNYKTTPPVLDSDGSFFLYSKLTVDKSRWQQGNVFSCSVMHEALHNHYTQKSLS LSPGK | 94 |
| MD2621 | EVQLVESGGGLVQPGGSLRLSCAVSISIFDIYAMDWYRQAPGKQRDLVATSFRDGSTNYADSVKGRFTI SRDNAKNTLYLQMNSLKPEDTAVYLCHVSLYRDPLGVAGGMGVYWGKGALVTVSSGGGGSGGGGSEVQL VESGGGLVQAGGSLKLSCAASGRTYAMGWFRQAPGKEREFVAHINALGTRTYYSDSVKGRFTISRDNAK NTEYLEMNNLKPEDTAVYYCTAQGQWRAAPVAVAAEYEFWGQGTQVTVSSGGGGSGGGGSEVQLVESGG GLVWPGGSLRLSCAATGFTLENKAIGWFRQTPGSEREGVLCISKSGSWTYYTDSMRGRFTISRDNAENT VYLQMDSLKPEDTAVYYCATTTAGGGLCWDGTTFSRLASSWGQGTQVTVSSAAADKTHTCPPCPAPELL GGPSVFLFPPKPKDTLMISRTPEVTCVVVDVSHEDPEVKFNWYVDGVEVHNAKTKPREEQYNSTYRVVS VLTVLHQDWLNGKEYKCKVSNKALPAPIEKTISKAKGWPREPQVYTLPPSREEMTKNQVSLTCLVKGFY PSDIAVEWESNGQPENNYKTTPPVLDSDGSFFLYSKLTVDKSRWQQGNVFSCSVMHEALHNHYTQKSLS LSPGK | 95 |
| MD2628 | EVQLVESGGGLVQPGGSLRLSCAVSISIFDIYAMDWYRQAPGKQRDLVATSFRDGSTNYADSVKGRFTI SRDNAKNTLYLQMNSLKPEDTAVYLCHVSLYRDPLGVAGGMGVYWGKGALVTVSSGGGGSGGGGSEVQL VESGGGLVQAGGSLKLSCAASGRTYAMGWFRQAPGKEREFVAHINALGTRTYYSDSVKGRFTISRDNAK NTEYLEMNNLKPEDTAVYYCTAQGQWRAAPVAVAAEYEFWGQGTQVTVSSAAADKTHTCPPCPAPELLG GPSVFLFPPKPKDTLMISRTPEVTCVVVDVSHEDPEVKFNWYVDGVEVHNAKTKPREEQYNSTYRVVSV LTVLHQDWLNGKEYKCKVSNKALPAPIEKTISKAKGQPREPQVYTLPPSREEMTKNQVSLTCLVKGFYP SDIAVEWESNGWPENNYKTTPPVLDSDGSFFLYSKLTVDKSRWQQGNVFSCSVMHEALHNHYTQKSLSL SPGKGGGGSGGGGSEVQLVESGGGLVWPGGSLRLSCAATGFTLENKAIGWFRQTPGSEREGVLCISKSG SWTYYTDSMRGRFTISRDNAENTVYLQMDSLKPEDTAVYYCATTTAGGGLCWDGTTFSRLASSWGQGTQ VTVSS | 96 |
| MD2629 | EVQLVESGGGLVQPGGSLRLSCAATGFTLENKAIGWFRQTPGSEREGVLCISKSGSWTYYTDSMRGRFT ISRDNAENTVYLQMDSLKPEDTAVYYCATTTAGGGLCWDGTTFSRLASSWGQGTQVTVSSAAADKTHTC PPCPAPELLGGPSVFLFPPKPKDTLMISRTPEVTCVVVDVSHEDPEVKFNWYVDGVEVHNAKTKPREEQ YNSTYRVVSVLTVLHQDWLNGKEYKCKVSNKALPAPIEKTISKAKGQPREPQVYTLPPSREEMTKNQVS LTCLVKGFYPSDIAVEWESNGQPENNYKTTPPVLDSDGSFFLYSKLTVDKSRWQQGNVFSCSVMHEALH NHYTQKSLSLSPGKGGGGSGGGGSEVQLVESGGGLVWPGGSLRLSCAVSISIFDIYAMDWYRQAPGKQR DLVATSFRDGSTNYADSVKGRFTISRDNAKNTLYLQMNSLKPEDTAVYLCHVSLYRDPLGVAGGMGVYW GKGALVTVSSGGGGSGGGGSEVQLVESGGGLVQAGGSLKLSCAASGRTYAMGWFRQAPGKEREFVAHIN ALGTRTYYSDSVKGRFTISRDNAKNTEYLEMNNLKPEDTAVYYCTAQGQWRAAPVAVAAEYEFWGQGTQ VTVSS | 97 |
| MD2641 | EVQLVESGGGLVQPGGSLRLSCAATGFTLENKAIGWFRQTPGSEREGVLCISKSGSWTYYTDSMRGRFT ISRDNAENTVYLQMDSLKPEDTAVYYCATTTAGGGLCWDGTTFSRLASSWGQGTQVTVSSGGGGSGGGG SEVQLVESGGGLVWPGGSLKLSCAASGFTFSTSWMYWLRQAPGKGLEWVSVINTDGGTYYADSVKDRFT ISRDNAKDTLYLQMSSLKSEDTAVYYCAKDWGGPEPTRGQGTQVTVSSDKTHTCPPCPAPELLGGPSVF LFPPKPKDTLMISRTPEVTCVVVDVSHEDPEVKFNWYVDGVEVHNAKTKPREEQYNSTYRVVSVLTVLH QDWLNGKEYKCKVSNKALPAPIEKTISKAKGWPREPQVYTLPPSREEMTKNQVSLTCLVKGFYPSDIAV EWESNGWPENNYKTTPPVLDSDGSFFLYSKLTVDKSRWQQGNVFSCSVMHEALHNHYTQKSLSLSPGKG GGGSGGGGSEVQLVESGGGLVWPGGSLRLSCAVSISIFDIYAMDWYRQAPGKQRDLVATSFRDGSTNYA DSVKGRFTISRDNAKNTLYLQMNSLKPEDTAVYLCHVSLYRDPLGVAGGMGVYWGKGALVTVSSGGGGS GGGGSEVQLVESGGGLVQAGGSLKLSCAASGRTYAMGWFRQAPGKEREFVAHINALGTRTYYSDSVKGR FTISRDNAKNTEYLEMNNLKPEDTAVYYCTAWGQWRAAPVAVAAEYEFWGWGTQVTVSS | 98 |
| MD2642 | EVQLVESGGGLVQPGGSLRLSCAVSISIFDIYAMDWYRQAPGKQRDLVATSFRDGSTNYADSVKGRFTI SRDNAKNTLYLQMNSLKPEDTAVYLCHVSLYRDPLGVAGGMGVYWGKGALVTVSSGGGGSGGGGSEVQL VESGGGLVQAGGSLKLSCAASGRTYAMGWFRQAPGKEREFVAHINALGTRTYYSDSVKGRFTISRDNAK | 99 |

TABLE 30-continued

Sequences of Fc-fusion constructs.

| Construct | Sequence | SEQ ID NO: |
|---|---|---|
| | NTEYLEMNNLKPEDTAVYYCTAQGQWRAAPVAVAAEYEFWGQGTQVTVSSDKTHTCPPCPAPELLGGPS VFLFPPKPKDTLMISRTPEVTCVVVDVSHEDPEVKFNWYVDGVEVHNAKTKPREEQYNSTYRVVSVLTV LHQDWLNGKEYKCKVSNKALPAPIEKTISKAKGWPREPQVYTLPPSREEMTKNQVSLTCLVKGFYPSDI AVEWESNGWPENNYKTTPPVLDSGSFFLYSKLTVDKSRWQQGNVFSCSVMHEALHNHYTQKSLSLSPG KGGGGSGGGGSEVQLVESGGGLVWPGGSLRLSCAATGFTLENKAIGWFRQTPGSEREGVLCISKSGSWT YYTDSMRGRFTISRDNAENTVYLQMDSLKPEDTAVYYCATTTAGGGLCWDGTTFSRLASSWGQGTQVTV SSGGGGSGGGGSEVQLVESGGGLVQPGGSLKLSCAASGFTFSTSWMYWLRQAPGKGLEWVSVINTDGGT YYADSVKDRFTISRDNAKDTLYLQMSSLKSEDTAVYYCAKDWGGPEPTRGQGTQVTVSS | |
| MD3606 | EVQLVESGGGLVQPGGSLRLSCAVSISIFDIYAMDWYRQAPGKQRDLVATSFRDGSTNYADSVKGRFTI SRDNAKNTLYLQMNSLKPEDTAVYLCHVSLYRDPLGVAGGMGVYWGKGALVTVSSGGGGSGGGGSEVQL VESGGGLVQAGGSLKLSCAASGRTYAMGWFRQAPGKEREFVAHINALGTRTYYSDSVKGRFTISRDNAK NTEYLEMNNLKPEDTAVYYCTAQGQWRAAPVAVAAEYEFWGQGTQVTVSSGGGGSGGGGSEVQLVESGG GLVWPGGSLRLSCAATGFTLENKAIGWFRQTPGSEREGVLCISKSGSWTYYTDSMRGRFTISRDNAENT VYLQMDSLKPEDTAVYYCATTTAGGGLCWDGTTFSRLASSWGQGTQVTVSSGGGGSGGGGSEVQLVESG GGLVQPGGSLKLSCAASGFTFSTSWMYWLRQAPGKGLEWVSVINTDGGTYYADSVKDRFTISRDNAKDT LYLQMSSLKSEDTAVYYCAKDWGGPEPTRGQGTQVTVSSDKTHTCPPCPAPELLGGPSVFLFPPKPKDT LMISRTPEVTCVVVDVSHEDPEVKFNWYVDGVEVHNAKTKPREEQYNSTYRVVSVLTVLHQDWLNGKEY KCKVSNKALPAPIEKTISKAKGWPREPQVYTLPPSREEMTKNQVSLTCLVKGFYPSDIAVEWESNGWPE NNYKTTPPVLDSDGSFFLYSKLTVDKSRWQQGNVFSCSVMHEALHNHYTQKSLSLSPGK | 100 |
| MD3609 | EVQLVESGGGLVQPGGSLRLSCAVSISIFDIYAMDWYRQAPGKQRDLVATSFRDGSTNYADSVKGRFTI SRDNAKNTLYLQMNSLKPEDTAVYLCHVSLYRDPLGVAGGMGVYWGKGALVTVSSGGGGSGGGGSEVQL VESGGGLVQAGGSLKLSCAASGRTYAMGWFRQAPGKEREFVAHINALGTRTYYSDSVKGRFTISRDNAK NTEYLEMNNLKPEDTAVYYCTAQGQWRAAPVAVAAEYEFWGQGTQVTVSSGGGGSGGGGSEVQLVESGG GLVWPGGSLRLSCAATGFTLENKAIGWFRQTPGSEREGVLCISKSGSWTYYTDSMRGRFTISRDNAENT VYLQMDSLKPEDTAVYYCATTTAGGGLCWDGTTFSRLASSWGQGTQVTVSSGGGGSGGGGSEVQLVESG GGLVQPGGSLKLSCAASGFTFSTSWMYWLRQAPGKGLEWVSVINTDGGTYYADSVKDRFTISRDNAKDT LYLQMSSLKSEDTAVYYCAKDWGGPEPTRGQGTQVTVSSAAADKTHTCPPCPAPELLGGPSVFLFPPKP KDTLMISRTPEVTCVVVDVSHEDPEVKFNWYVDGVEVHNAKTKPREEQYNSTYRVVSVLTVLHQDWLNG KEYKCKVSNKALPAPIEKTISKAKGWPREPQVYTLPPSREEMTKNQVSLTCLVKGFYPSDIAVEWESNG QPENNYKTTPPVLDSDGSFFLYSKLTVDKSRWQQGNVFSCSVMHEALHNHYTQKSLSLSPGK | 101 |
| MD2631 | EVQLVESGGGLVQPGGSLRLSCAVSISIFDIYAMDWYRQAPGKQRDLVATSFRDGSTNYADSVKGRFTI SRDNAKNTLYLQMNSLKPEDTAVYLCHVSLYRDPLGVAGGMGVYWGKGALVTVSSGGGGSGGGGSEVQL VESGGGLVWPGGSLRLSCAVSISIFDIYAMDWYRQAPGKQRDLVATSFRDGSTNYADSVKGRFTISRDN AKNTLYLQMNSLKPEDTAVYLCHVSLYRDPLGVAGGMGVYWGKGALVTVSSGGGGSGGGGSEVQLVESG GGLVQAGGSLKLSCAASGRTYAMGWFRQAPGKEREFVAHINALGTRTYYSDSVKGRFTISRDNAKNTEY LEMNNLKPEDTAVYYCTAQGQWRAAPVAVAAEYEFWGQGTQVTVSSDKTHTCPPCPAPELLGGPSVFLF PPKPKDTLMISRTPEVTCVVVDVSHEDPEVKFNWYVDGVEVHNAKTKPREEQYNSTYRVVSVLTVLHQD WLNGKEYKCKVSNKALPAPIEKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMHEALHNHYTQKSLSLSPGKGGG GSGGGGSEVQLVESGGGLVQPGGSLKLSCAASGFTFSTSWMYWLRQAPGKGLEWVSVINTDGGTYYADS VKDRFTISRDNAKDTLYLQMSSLKSEDTAVYYCAKDWGGPEPTRGQGTQVTVSSGGGGSGGGGSEVQLV ESGGGLVWPGGSLRLSCAATGFTLENKAIGWFRQTPGSEREGVLCISKSGSWTYYTDSMRGRFTISRDN AENTVYLQMDSLKPEDTAVYYCATTTAGGGLCWDGTTFSRLASSWGQGTQVTVSS | 102 |
| MD2632 | EVQLVESGGGLVQPGGSLRLSCAVSISIFDIYAMDWYRQAPGKQRDLVATSFRDGSTNYADSVKGRFTI SRDNAKNTLYLQMNSLKPEDTAVYLCHVSLYRDPLGVAGGMGVYWGKGALVTVSSGGGGSGGGGSEVQL VESGGGLVWPGGSLRLSCAVSISIFDIYAMDWYRQAPGKQRDLVATSFRDGSTNYADSVKGRFTISRDN AKNTLYLQMNSLKPEDTAVYLCHVSLYRDPLGVAGGMGVYWGKGALVTVSSGGGGSGGGGSEVQLVESG GGLVQAGGSLKLSCAASGRTYAMGWFRQAPGKEREFVAHINALGTRTYYSDSVKGRFTISRDNAKNTEY LEMNNLKPEDTAVYYCTAQGQWRAAPVAVAAEYEFWGQGTQVTVSSDKTHTCPPCPAPELLGGPSVFLF PPKPKDTLMISRTPEVTCVVVDVSHEDPEVKFNWYVDGVEVHNAKTKPREEQYNSTYRVVSVLTVLHQD WLNGKEYKCKVSNKALPAPIEKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMHEALHNHYTQKSLSLSPGKGGG GSGGGGSEVQLVESGGGLVQPGGSLRLSCAATGFTLENKAIGWFRQTPGSEREGVLCISKSGSWTYYTD SMRGRFTISRDNAENTVYLQMDSLKPEDTAVYYCATTTAGGGLCWDGTTFSRLASSWGQGTQVTVSSGG GGSGGGGSEVQLVESGGGLVWPGGSLKLSCAASGFTFSTSWMYWLRQAPGKGLEWVSVINTDGGTYYAD SVKDRFTISRDNAKDTLYLQMSSLKSEDTAVYYCAKDWGGPEPTRGQGTQVTVSS | 103 |
| MD2633 | EVQLVESGGGLVQAGGSLKLSCAASGRTYAMGWFRQAPGKEREFVAHINALGTRTYYSDSVKGRFTISR DNAKNTEYLEMNNLKPEDTAVYYCTAQGQWRAAPVAVAAEYEFWGQGTQVTVSSGGGGSGGGGSEVQLV ESGGGLVWPGGSLRLSCAVSISIFDIYAMDWYRQAPGKQRDLVATSFRDGSTNYADSVKGRFTISRDNA KNTLYLQMNSLKPEDTAVYLCHVSLYRDPLGVAGGMGVYWGKGALVTVSSGGGGSGGGGSEVQLVESGG GLVWPGGSLRLSCAVSISIFDIYAMDWYRQAPGKQRDLVATSFRDGSTNYADSVKGRFTISRDNAKNTL YLQMNSLKPEDTAVYLCHVSLYRDPLGVAGGMGVYWGKGALVTVSSDKTHTCPPCPAPELLGGPSVFLF PPKPKDTLMISRTPEVTCVVVDVSHEDPEVKFNWYVDGVEVHNAKTKPREEQYNSTYRVVSVLTVLHQD WLNGKEYKCKVSNKALPAPIEKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMHEALHNHYTQKSLSLSPGKGGG GSGGGGSEVQLVESGGGLVQPGGSLKLSCAASGFTFSTSWMYWLRQAPGKGLEWVSVINTDGGTYYADS VKDRFTISRDNAKDTLYLQMSSLKSEDTAVYYCAKDWGGPEPTRGQGTQVTVSSGGGGSGGGGSEVQLV ESGGGLVWPGGSLRLSCAATGFTLENKAIGWFRQTPGSEREGVLCISKSGSWTYYTDSMRGRFTISRDN AENTVYLQMDSLKPEDTAVYYCATTTAGGGLCWDGTTFSRLASSWGQGTQVTVSS | 104 |

TABLE 30-continued

Sequences of Fc-fusion constructs.

| Construct | Sequence | SEQ ID NO: |
|---|---|---|
| MD2634 | EVQLVESGGGLVQAGGSLKLSCAASGRTYAMGWFRQAPGKEREFVAHINALGTRTYYSDSVKGRFTISR DNAKNTEYLEMNNLKPEDTAVYYCTAQGQWRAAPVAVAAEYEFWGQGTQVTVSSGGGGSGGGGSEVQLV ESGGGLVWPGGSLRLSCAVSISIFDIYAMDWYRQAPGKQRDLVATSFRDGSTNYADSVKGRFTISRDNA KNTLYLQMNSLKPEDTAVYLCHVSLYRDPLGVAGGMGVYWGKGALVTVSSGGGGSGGGGSEVQLVESGG GLVWPGGSLRLSCAVSISIFDIYAMDWYRQAPGKQRDLVATSFRDGSTNYADSVKGRFTISRDNAKNTL YLQMNSLKPEDTAVYLCHVSLYRDPLGVAGGMGVYWGKGALVTVSSDKTHTCPPCPAPELLGGPSVFLF PPKPKDTLMISRTPEVTCVVVDVSHEDPEVKFNWYVDGVEVHNAKTKPREEQYNSTYRVVSVLTVLHQD WLNGKEYKCKVSNKALPAPIEKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMHEALHNHYTQKSLSLSPGKGGG GSGGGGSEVQLVESGGGLVQPGGSLRLSCAATGFTLENKAIGWFRQTPGSEREGVLCISKSGSWTYYTD SMRGRFTISRDNAENTVYLQMDSLKPEDTAVYYCATTTAGGGLCWDGTTFSRLASSWGQGTQVTVSSGG GGSGGGGSEVQLVESGGGLVWPGGSLKLSCAASGFTFSTSWMYWLRQAPGKGLEWVSVINTDGGTYYAD SVKDRFTISRDNAKDTLYLQMSSLKSEDTAVYYCAKDWGGPEPTRGQGTQVTVSS | 105 |
| MD2622 | EVQLVESGGGLVQPGGSLRLSCAVSISIFDIYAMDWYRQAPGKQRDLVATSFRDGSTNYADSVKGRFTI SRDNAKNTLYLQMNSLKPEDTAVYLCHVSLYRDPLGVAGGMGVYWGKGALVTVSSGGGGSGGGGSEVQL VESGGGLVQAGGSLKLSCAASGRTYAMGWFRQAPGKEREFVAHINALGTRTYYSDSVKGRFTISRDNAK NTEYLEMNNLKPEDTAVYYCTAQGQWRAAPVAVAAEYEFWGQGTQVTVSSAAADKTHTCPPCPAPELLG GPSVFLFPPKPKDTLMISRTPEVTCVVVDVSHEDPEVKFNWYVDGVEVHNAKTKPREEQYNSTYRVVSV LTVLHQDWLNGKEYKCKVSNKALPAPIEKTISKAKGQPREPQVYTLPPSREEMTKNQVSLTCLVKGFYP SDIAVEWESNGQPENNYKTTPPVLDSDGSFFLYSRLTVDKSRWQQGNVFSCSVMHEALHNHYTQKSLSL SPGK | 106 |
| | EVQLVESGGGLVQPGGSLRLSCAATGFTLENKAIGWFRQTPGSEREGVLCISKSGSWTYYTDSMRGRFT ISRDNAENTVYLQMDSLKPEDTAVYYCATTTAGGGLCWDGTTFSRLASSWGQGTQVTVSSAAADKTHTC PPCPAPELLGGPSVFLFPPKPKDTLMISRTPEVTCVVVDVSHEDPEVKFNWYVDGVEVHNAKTKPREEQ YNSTYRVVSVLTVLHQDWLNGKEYKCKVSNKALPAPIEKTISKAKGQPREPQVYTLPPSREEMTKNQVS LTCLVKGFYPSDIAVEWESNGQPENNYKTTPPVLDSDGSFFLYSKLTVDKSRWQQGNVFSCSVMHEALH NHYTQKSLSLSPGK | 107 |
| MD2643 | EVQLVESGGGLVQPGGSLRLSCAVSISIFDIYAMDWYRQAPGKQRDLVATSFRDGSTNYADSVKGRFTI SRDNAKNTLYLQMNSLKPEDTAVYLCHVSLYRDPLGVAGGMGVYWGKGALVTVSSGGGGSGGGGSEVQL VESGGGLVWPGGSLRLSCAVSISIFDIYAMDWYRQAPGKQRDLVATSFRDGSTNYADSVKGRFTISRDN AKNTLYLQMNSLKPEDTAVYLCHVSLYRDPLGVAGGMGVYWGKGALVTVSSGGGGSGGGGSEVQLVESG GGLVQAGGSLKLSCAASGRTYAMGWFRQAPGKEREFVAHINALGTRTYYSDSVKGRFTISRDNAKNTEY LEMNNLKPEDTAVYYCTAQGQWRAAPVAVAAEYEFWGQGTQVTVSSDKTHTCPPCPAPELLGGPSVFLF PPKPKDTLMISRTPEVTCVVVDVSHEDPEVKFNWYVDGVEVHNAKTKPREEQYNSTYRVVSVLTVLHQD WLNGKEYKCKVSNKALPAPIEKTISKAKGQPREPQVYTLPPSREEMTKNQVSLTCLVKGFYPSDIAVEW ESNGQPENNYKTTPPVLDSDGSFFLYSRLTVDKSRWQQGNVFSCSVMHEALHNHYTQKSLSLSPGK | 110 |
| | EVQLVESGGGLVQPGGSLRLSCAATGFTLENKAIGWFRQTPGSEREGVLCISKSGSWTYYTDSMRGRFT ISRDNAENTVYLQMDSLKPEDTAVYYCATTTAGGGLCWDGTTFSRLASSWGQGTQVTVSSGGGGSGGGG SEVQLVESGGGLVWPGGSLKLSCAASGFTFSTSWMYWLRQAPGKGLEWVSVINTDGGTYYADSVKDRFT ISRDNAKDTLYLQMSSLKSEDTAVYYCAKDWGGPEPTRGQGTQVTVSSDKTHTCPPCPAPELLGGPSVF LFPPKPKDTLMISRTPEVTCVVVDVSHEDPEVKFNWYVDGVEVHNAKTKPREEQYNSTYRVVSVLTVLH QDWLNGKEYKCKVSNKALPAPIEKTISKAKGQPREPQVYTLPPSREEMTKNQVSLTCLVKGFYPSDIAV EWESNGWPENNYKTTPPVLDSDGSFFLYSKLTVDKSRWQQGNVFSCSVMHEALHNHYTQKSLSLSPGK | 111 |
| MD2644 | EVQLVESGGGLVQPGGSLRLSCAVSISIFDIYAMDWYRQAPGKQRDLVATSFRDGSTNYADSVKGRFTI SRDNAKNTLYLQMNSLKPEDTAVYLCHVSLYRDPLGVAGGMGVYWGKGALVTVSSGGGGSGGGGSEVQL VESGGGLVWPGGSLRLSCAVSISIFDIYAMDWYRQAPGKQRDLVATSFRDGSTNYADSVKGRFTISRDN AKNTLYLQMNSLKPEDTAVYLCHVSLYRDPLGVAGGMGVYWGKGALVTVSSGGGGSGGGGSEVQLVESG GGLVQAGGSLKLSCAASGRTYAMGWFRQAPGKEREFVAHINALGTRTYYSDSVKGRFTISRDNAKNTEY LEMNNLKPEDTAVYYCTAQGQWRAAPVAVAAEYEFWGQGTQVTVSSDKTHTCPPCPAPELLGGPSVFLF PPKPKDTLMISRTPEVTCVVVDVSHEDPEVKFNWYVDGVEVHNAKTKPREEQYNSTYRVVSVLTVLHQD WLNGKEYKCKVSNKALPAPIEKTISKAKGQPREPQVYTLPPSREEMTKNQVSLTCLVKGFYPSDIAVEW ESNGQPENNYKTTPPVLDSDGSFFLYSRLTVDKSRWQQGNVFSCSVMHEALHNHYTQKSLSLSPGK | 112 |
| | EVQLVESGGGLVWPGGSLKLSCAASGFTFSTSWMYWLRQAPGKGLEWVSVINTDGGTYYADSVKDRFTI SRDNAKDTLYLQMSSLKSEDTAVYYCAKDWGGPEPTRGQGTQVTVSSGGGGSGGGGSEVQLVESGGGLV QPGGSLRLSCAATGFTLENKAIGWFRQTPGSEREGVLCISKSGSWTYYTDSMRGRFTISRDNAENTVYL QMDSLKPEDTAVYYCATTTAGGGLCWDGTTFSRLASSWGQGTQVTVSSDKTHTCPPCPAPELLGGPSVF LFPPKPKDTLMISRTPEVTCVVVDVSHEDPEVKFNWYVDGVEVHNAKTKPREEQYNSTYRVVSVLTVLH QDWLNGKEYKCKVSNKALPAPIEKTISKAKGQPREPQVYTLPPSREEMTKNQVSLTCLVKGFYPSDIAV EWESNGWPENNYKTTPPVLDSDGSFFLYSKLTVDKSRWQQGNVFSCSVMHEALHNHYTQKSLSLSPGK | 113 |
| MD2645 | EVQLVESGGGLVQAGGSLKLSCAASGRTYAMGWFRQAPGKEREFVAHINALGTRTYYSDSVKGRFTISR DNAKNTEYLEMNNLKPEDTAVYYCTAQGQWRAAPVAVAAEYEFWGQGTQVTVSSGGGGSGGGGSEVQLV ESGGGLVWPGGSLRLSCAVSISIFDIYAMDWYRQAPGKQRDLVATSFRDGSTNYADSVKGRFTISRDNA KNTLYLQMNSLKPEDTAVYLCHVSLYRDPLGVAGGMGVYWGKGALVTVSSGGGGSGGGGSEVQLVESGG GLVWPGGSLRLSCAVSISIFDIYAMDWYRQAPGKQRDLVATSFRDGSTNYADSVKGRFTISRDNAKNTL YLQMNSLKPEDTAVYLCHVSLYRDPLGVAGGMGVYWGKGALVTVSSDKTHTCPPCPAPELLGGPSVFLF PPKPKDTLMISRTPEVTCVVVDVSHEDPEVKFNWYVDGVEVHNAKTKPREEQYNSTYRVVSVLTVLHQD WLNGKEYKCKVSNKALPAPIEKTISKAKGQPREPQVYTLPPSREEMTKNQVSLTCLVKGFYPSDIAVEW ESNGQPENNYKTTPPVLDSDGSFFLYSRLTVDKSRWQQGNVFSCSVMHEALHNHYTQKSLSLSPGK | 114 |

TABLE 30-continued

Sequences of Fc-fusion constructs.

| Construct | Sequence | SEQ ID NO: |
|---|---|---|
|  | EVQLVESGGGLVQPGGSLRLSCAATGFTLENKAIGWFRQTPGSEREGVLCISKSGSWTYYTDSMRGRFT<br>ISRDNAENTVYLQMDSLKPEDTAVYYCATTTAGGGLCWDGTTFSRLASSWGQGTQVTVSSGGGGSGGGG<br>SEVQLVESGGGLVWPGGSLKLSCAASGFTFSTSWMYWLRQAPGKGLEWVSVINTDGGTYYADSVKDRFT<br>ISRDNAKDTLYLQMSSLKSEDTAVYYCAKDWGGPEPTRGQGTQVTVSSDKTHTCPPCPAPELLGGPSVF<br>LFPPKPKDTLMISRTPEVTCVVVDVSHEDPEVKFNWYVDGVEVHNAKTKPREEQYNSTYRVVSVLTVLH<br>QDWLNGKEYKCKVSNKALPAPIEKTISKAKGQPREPQVYTLPPSREEMTKNQVSLTCLVKGFYPSDIAV<br>EWESNGWPENNYKTTPPVLDSDGSFLLYSKLTVDKSRWQQGNVFSCSVMHEALHNHYTQKSLSLSPGK | 115 |
| MD2646 | EVQLVESGGGLVQAGGSLKLSCAASGRTYAMGWFRQAPGKEREFVAHINALGTRTYYSDSVKGRFTISR<br>DNAKNTEYLEMNNLKPEDTAVYYCTAQGQWRAAPVAVAAEYEFWGQGTQVTVSSGGGGSGGGGSEVQLV<br>ESGGGLVWPGGSLRLSCAVSISIFDIYAMDWYRQAPGKQRDLVATSFRDGSTNYADSVKGRFTISRDNA<br>KNTLYLQMNSLKPEDTAVYLCHVSLYRDPLGVAGGMGVYWGKGALVTVSSGGGGSGGGGSEVQLVESGG<br>GLVWPGGSLRLSCAVSISIFDIYAMDWYRQAPGKQRDLVATSFRDGSTNYADSVKGRFTISRDNAKNTL<br>YLQMNSLKPEDTAVYLCHVSLYRDPLGVAGGMGVYWGKGALVTVSSDKTHTCPPCPAPELLGGPSVFLF<br>PPKPKDTLMISRTPEVTCVVVDVSHEDPEVKFNWYVDGVEVHNAKTKPREEQYNSTYRVVSVLTVLHQD<br>WLNGKEYKCKVSNKALPAPIEKTISKAKGQPREPQVYTLPPSREEMTKNQVSLTCLVKGFYPSDIAVEW<br>ESNGQPENNYKTTPPVLDSDGSFFLYSRLTVDKSRWQQGNVFSCSVMHEALHNYTQKSLSLSPGK | 116 |
|  | EVQLVESGGGLVWPGGSLKLSCAASGFTFSTSWMYWLRQAPGKGLEWVSVINTDGGTYYADSVKDRFTI<br>SRDNAKDTLYLQMSSLKSEDTAVYYCAKDWGGPEPTRGQGTQVTVSSGGGGSGGGGSEVQLVESGGGLV<br>QPGGSLRLSCAATGFTLENKAIGWFRQTPGSEREGVLCISKSGSWTYYTDSMRGRFTISRDNAENTVYL<br>QMDSLKPEDTAVYYCATTTAGGGLCWDGTTFSRLASSWGQGTQVTVSSDKTHTCPPCPAPELLGGPSVF<br>LFPPKPKDTLMISRTPEVTCVVVDVSHEDPEVKFNWYVDGVEVHNAKTKPREEQYNSTYRVVSVLTVLH<br>QDWLNGKEYKCKVSNKALPAPIEKTISKAKGQPREPQVYTLPPSREEMTKNQVSLTCLVKGFYPSDIAV<br>EWESNGWPENNYKTTPPVLDSDGSFLLYSKLTVDKSRWQQGNVFSCSVMHEALHNHYTQKSLSLSPGK | 117 |
| MD2647 | EVQLVESGGGLVQPGGSLRLSCAVSISIFDIYAMDWYRQAPGKQRDLVATSFRDGSTNYADSVKGRFTI<br>SRDNAKNTLYLQMNSLKPEDTAVYLCHVSLYRDPLGVAGGMGVYWGKGALVTVSSDKTHTCPPCPAPEL<br>LGGPSVFLFPPKPKDTLMISRTPEVTCVVVDVSHEDPEVKFNWYVDGVEVHNAKTKPREEQYNSTYRVV<br>SVLTVLHQDWLNGKEYKCKVSNKALPAPIEKTISKAKGQPREPQVYTLPPSREEMTKNQVSLTCLVKGF<br>YPSDIAVEWESNGWPENNYKTTPPVLDSDGSFFLYSRLTVDKSRWQQGNVFSCSVMHEALHNHYTQKSL<br>SLSPGKGGGGSGGGGSEVQLVESGGGLVWPGGSLRLSCAATGFTLENKAIGWFRQTPGSEREGVLCISK<br>SGSWTYYTDSMRGRFTISRDNAENTVYLQMDSLKPEDTAVYYCATTTAGGGLCWDGTTFSRLASSWGQG<br>TQVTVSS | 118 |
|  | EVQLVESGGGLVQAGGSLKLSCAASGRTYAMGWFRQAPGKEREFVAHINALGTRTYYSDSVKGRFTISR<br>DNAKNTEYLEMNNLKPEDTAVYYCTAQGQWRAAPVAVAAEYEFWGQGTQVTVSSGGGGSGGGGSEVQLV<br>ESGGGLVWPGGSLRLSCAVSISIFDIYAMDWYRQAPGKQRDLVATSFRDGSTNYADSVKGRFTISRDNA<br>KNTLYLQMNSLKPEDTAVYLCHVSLYRDPLGVAGGMGVYWGKGALVTVSSDKTHTCPPCPAPELLGGPS<br>VFLFPPKPKDTLMISRTPEVTCVVVDVSHEDPEVKFNWYVDGVEVHNAKTKPREEQYNSTYRVVSVLTV<br>LHQDWLNGKEYKCKVSNKALPAPIEKTISKAKGWPREPQVYTLPPSREEMTKNQVSLTCLVKGFYPSDI<br>AVEWESNGWPENNYKTTPPVLDSDGSFLLYSKLTVDKSRWQQGNVFSCSVMHEALHNHYTQKSLSLSPG<br>KGGGGSGGGGSEVQLVESGGGLVWPGGSLKLSCAASGFTFSTSWMYWLRQAPGKGLEWVSVINTDGGTY<br>YADSVKDRFTISRDNAKDTLYLQMSSLKSEDTAVYYCAKDWGGPEPTRGQGTQVTVSS | 119 |
| MD2649 | EVQLVESGGGLVQPGGSLRLSCAVSISIFDIYAMDWYRQAPGKQRDLVATSFRDGSTNYADSVKGRFTI<br>SRDNAKNTLYLQMNSLKPEDTAVYLCHVSLYRDPLGVAGGMGVYWGKGALVTVSSGGGGSGGGGSEVQL<br>VESGGGLVQAGGSLKLSCAASGRTYAMGWFRQAPGKEREFVAHINALGTRTYYSDSVKGRFTISRDNAK<br>NTEYLEMNNLKPEDTAVYYCTAQGQWRAAPVAVAAEYEFWGQGTQVTVSSDKTHTCPPCPAPELLGGPS<br>VFLFPPKPKDTLMISRTPEVTCVVVDVSHEDPEVKFNWYVDGVEVHNAKTKPREEQYNSTYRVVSVLTV<br>LHQDWLNGKEYKCKVSNKALPAPIEKTISKAKGWPREPQVYTLPPSREEMTKNQVSLTCLVKGFYPSDI<br>AVEWESNGWPENNYKTTPPVLDSDGSFFLYSRLTVDKSRWQQGNVFSCSVMHEALHNYTQKSLSLSPG<br>K | 120 |
|  | EVQLVESGGGLVQPGGSLRLSCAATGFTLENKAIGWFRQTPGSEREGVLCISKSGSWTYYTDSMRGRFT<br>ISRDNAENTVYLQMDSLKPEDTAVYYCATTTAGGGLCWDGTTFSRLASSWGQGTQVTVSSGGGGSGGGG<br>SEVQLVESGGGLVWPGGSLKLSCAASGFTFSTSWMYWLRQAPGKGLEWVSVINTDGGTYYADSVKDRFT<br>ISRDNAKDTLYLQMSSLKSEDTAVYYCAKDWGGPEPTRGQGTQVTVSSDKTHTCPPCPAPELLGGPSVF<br>LFPPKPKDTLMISRTPEVTCVVVDVSHEDPEVKFNWYVDGVEVHNAKTKPREEQYNSTYRVVSVLTVLH<br>QDWLNGKEYKCKVSNKALPAPIEKTISKAKGQPREPQVYTLPPSREEMTKNQVSLTCLVKGFYPSDIAV<br>EWESNGWPENNYKTTPPVLDSDGSFLLYSKLTVDKSRWQQGNVFSCSVMHEALHNHYTQKSLSLSPGK | 121 |

Influenza Neutralization by Fc-Containing Multi-Domain Antibodies

Purified Fc-containing single- and multi-domain antibody constructs were tested in influenza virus neutralization assays as described in Example 6 and showed improved potency and breadth when compared to sdAb building blocks. Results are shown for influenza neutralizing Fc fusion constructs in Tables 31-37.

TABLE 31

Average neutralization titers (nM) of sdAb Fc fusion constructs
(empty cells mean 'not tested').

| | Virus strain | MD2605 | MD2606 | MD2607 | MD2608 | MD2609 | MD2610 |
|---|---|---|---|---|---|---|---|
| H1N1 | A/Puerto Rico/8/34-MA | | | 1262.6 | | | |
| H5N1 | A/Vietnam/1194/04 | 8.4 | 5.8 | | | | |
| H2N2 | A/Guiyang/1/57 | 23.7 | | | | | |
| H2N2 | A/WF/HK/MPU3156/05 | 13.3 | | | | | |
| H3N2 | A/Brisbane/10/07 | 25.1 | 22.1 | | | | |
| H3N2 | A/Wisconsin/67/05 | 37.8 | 27.7 | | | | |
| H7N3 | A/NIBRG/60 (A/mallard/Netherlands/12/00) | 97.5 | 70.0 | | | | |
| H7N7 | A/PR8 H7N7-NY | 508.6 | 1255.6 | | | | |
| H7N9 | A/Anhui/1/13 | 189.7 | | | | | |
| Yamagata | B/Florida/04/06 | | | 252.5 | 248.6 | 1.4 | 1.4 |

TABLE 32

Average neutralization titers (nM) of sdAb dimer Fc fusion constructs
(empty cells mean 'not tested').

| | Virus strain | MD2601 | MD2602 | MD2603 | MD2604 | MD2611 | MD2612 | MD2613 | MD2614 |
|---|---|---|---|---|---|---|---|---|---|
| H1N1 | A/New Caledonia/20/99 | 23.5 | 20.2 | 78.9 | 34.0 | 17.3 | 49.0 | 42.2 | 21.1 |
| H1N1 | A/Puerto Rico/8/34-MA | 9.5 | 22.9 | 53.9 | 51.5 | | | | |
| H5N1 | A/Vietnam/1194/04 | 16.6 | | | | 10.3 | | | |
| H3N2 | A/Brisbane/10/07 | 50.9 | 72.0 | 634.1 | 271.6 | 41.8 | 277.2 | 142.0 | 142.0 |
| H3N2 | A/HK/1/68-MA | 245.5 | 479.7 | 491.0 | 102.8 | | | | |
| H3N2 | A/Wisconsin/67/05 | 503.3 | 551.5 | >1000 | 685.3 | 147.0 | >1000 | >1000 | 285.3 |
| H7N3 | ANIBRG/60 (A/mallard/NL/12/00) | 669.6 | >1000 | >1000 | >1000 | 247.2 | >1000 | >1000 | >1000 |
| H7N7 | A/PR8 H7N7-NY | >1000 | >1000 | >1000 | >1000 | >1000 | >1000 | >1000 | >1000 |
| Yamagata | B/Florida/04/06 | 476.2 | 6.4 | 194.5 | 1.1 | 329.7 | 329.7 | 0.6 | 11.9 |
| Old | B/Lee/40 | 360.3 | 317.3 | 202.5 | 126.4 | | | | |

TABLE 33

Average neutralization titers (nM) of sdAb dimer-Fc fusion constructs
(empty cells mean 'not tested').

| | Virus strain | MD2615 | MD2616 | MD2617 | MD2618 | MD2626 |
|---|---|---|---|---|---|---|
| H1N1 | A/California/07/09 | | | 1.8 | | |
| H1N1 | ANew Caledonia/20/99 | 12.2 | 20.6 | 8.4 | | |
| H1N1 | A/Puerto Rico/8/34-MA | | | 6.3 | | |
| H5N1 | A/Vietnam/1194/04 | 14.5 | | 4.7 | | |
| H2N2 | A/Guiyang/1/57 | | | 31.8 | | |
| H6N1 | A/Eurasian Wigeon/MPG1884/09 | | | 25.1 | | |
| H11N9 | A/Northern Pintail/MPC2085/07 | | | 21.1 | | |
| H9N2 | A/HK/466419/09 | | | 25.1 | | |
| H8N4 | A/Eurasian Wigeon/MPH571/08 | | | 12.5 | | |
| H3N2 | A/Brisbane/10/07 | 26.8 | 932.3 | 27.5 | >1000 | |
| H3N2 | A/HK/1/68-MA | | | 117.7 | | |
| H3N2 | A/Wisconsin/67/05 | 39.5 | 932.3 | 498.7 | >1000 | 47.8 |
| H4 | A/WF/HK/MPA892/06 | | | 35.5 | | |
| H7N3 | A/NIBRG/60 (A/mallard/Netherlands/12/00) | 83.2 | 932.3 | 72.1 | >1000 | 95.6 |
| H7N7 | A/PR8 H7N7-NY | 397.9 | 932.3 | 301.2 | >1000 | 321.4 |
| H7N9 | A/Anhui/1/13 | | | 380.0 | | |
| H7N9 | A/Shanghai/1/13 (R292K Tamiflu escape mutant) | | | 1900.0 | | |
| H7N9 | A/Shanghai/2/13 | | | 390.8 | | |
| H10N7 | A/Chick/Germany/N/49 | | | 21.1 | | |
| Victoria | B/Brisbane/60/08 | | | 2.1 | | |
| Victoria | B/Malaysia/2506/04 | | | 8.3 | | |
| Yamagata | B/Florida/04/06 | 164.8 | 233.1 | 2.5 | 0.8 | |
| Yamagata | B/Harbin/7/94 | | | 7.5 | | |
| Old | B/Lee/40 | | | 1.4 | | |

TABLE 34

Average neutralization titers (nM) of sdAb trimer Fc fusion constructs (empty cells mean 'not tested').

| | Virus strain | MD2619 | MD2620 | MD2621 | MD2628 | MD2629 |
|---|---|---|---|---|---|---|
| H1N1 | A/California/07/09 | | | | 3.2 | 5.5 |
| H1N1 | A/New Caledonia/20/99 | 26.2 | 15.5 | 13.1 | | |
| H5N1 | A/Vietnam/1194/04 | | | | 6.3 | 13.1 |
| H3

TABLE 35-continued

Average neutralization titers (nM) of sdAb tetramer Fc fusion constructs
(empty cells mean 'not tested').

| | Virus strain | MD2641 | MD2642 | MD3606 | MD3609 |
|---|---|---|---|---|---|
| H7N10 | A/Shanghai/1/13 (R292K Tamiflu escape mutant) | | 54.8 | 32.2 | 77.3 |
| H7N11 | A/Shanghai/2/13 | 17.4 | 24.7 | 22.8 | |
| H10N7 | A/Chick/Germany/N/49 | 6.9 | 11.9 | 10.2 | 30.9 |
| H10N8 | A/Jiangxi/346/2013 | | | 18.3 | |
| H10N3 | A/Conunon Teal/MPH11/08 | | | 11.3 | |
| H10N9 | A/Northern Shoveler/MPE2531/08 | | | 20.7 | |
| Victoria | B/Brisbane/60/08 | | 1.5 | 1.0 | 4.1 |
| Victoria | B/Malaysia/2506/04 | 5.5 | 3.5 | 2.6 | 5.5 |
| Yamagata | B/Florida/04/06 | 1.7 | 1.8 | 1.0 | 5.5 |
| Yamagata | B/Harbin/7/94 | 1.2 | 1.1 | 1.0 | 1.4 |
| Yamagata | B/Massachusetts/02/12 | | 1.0 | 1.0 | |
| Old | B/Lee/40 | | 8.4 | 3.3 | 21.9 |

TABLE 36

Average neutralization titers (nM) of sdAb pentamer-Fc fusion constructs
(empty cells mean 'not tested').

| | Virus strain | MD2631 | MD2632 | MD2633 | MD2634 |
|---|---|---|---|---|---|
| H1N1 | A/California/07/09 | 1.5 | 1.5 | 1.2 | 2.1 |
| H1N1 | A/New Caledonia/20/99 | 6.6 | 4.7 | 3.9 | 9.3 |
| H1N1 | A/Puerto Rico/8/34-MA | 9.3 | 9.3 | 9.3 | 11.1 |
| H5N1 | A/Vietnam/1194/04 | 9.3 | 6.6 | 6.6 | 7.9 |
| H2N2 | A/Guiyang/1/57 | 10.5 | | 20.9 | |
| H6N1 | A/Eurasian Wigeon/MPG1884/09 | 6.0 | | | |
| H11N9 | A/Northern Pintail/MPC2085/07 | 13.9 | | | |
| H9N2 | A/HK/466419/09 | 6.0 | | | |
| H8N4 | A/Eurasian Wigeon/MPH571/08 | 6.0 | | | |
| H3N2 | A/HK/1/68-MA | 13.2 | 18.7 | 4.7 | 9.3 |
| H3N2 | A/Wisconsin/67/05 | 11.1 | 11.1 | 15.7 | 22.2 |
| H4 | A/WF/HK/MPA892/06 | 7.0 | 7.0 | 2.5 | 2.5 |
| H7N7 | A/PR8 H7N7-NY | 13.2 | 11.1 | 3.3 | 6.6 |
| H7N9 | A/Anhui/1/13 | 54.2 | | 127.8 | |
| H7N9 | A/Shanghai/1/13 (R292K Tamiflu escape mutant) | 46.7 | | | |
| H7N9 | A/Shanghai/2/13 | 35.3 | | 36.1 | |
| H10N7 | A/Chick/Germany/N/49 | 5.0 | 8.3 | 4.2 | 5.9 |
| Victoria | B/Malaysia/2506/04 | 6.6 | 4.7 | 4.7 | 3.3 |
| Yamagata | B/Florida/04/06 | 1.8 | 1.2 | 2.1 | 1.5 |
| Yamagata | B/Harbin/7/94 | 2.3 | 2.0 | 1.0 | 1.4 |

TABLE 37

Average neutralization titers (nM) of heterodimeric Fc fusion
constructs (empty cells mean 'not tested').

| | Virus strain | MD2622 | MD2623 | MD2643 | MD2644 | MD2645 | MD2646 | MD2647 |
|---|---|---|---|---|---|---|---|---|
| H1N1 | A/California/07/09 | | | 2.8 | 2.3 | 2.3 | 1.6 | 2.0 |
| H1N1 | A/New Caledonia/20/99 | | | 7.4 | 7.4 | 14.8 | 14.8 | 12.4 |
| H1N1 | A/Puerto Rico/8/34-MA | | | 14.8 | 14.8 | 14.8 | 14.8 | 14.8 |
| H5N1 | A/Vietnam/1194/04 | | | 12.4 | 14.8 | 14.8 | 14.8 | 14.8 |
| H2N2 | A/Guiyang/1/57 | | | | 18.2 | | 36.1 | |
| H6N1 | A/Eurasian Wigeon/MPG1884/09 | | | | 22.0 | | | |
| H11N9 | A/Northern Pintail/MPC2085/07 | | | | 13.1 | | | |
| H9N2 | A/HK/466419/09 | | | | 9.0 | | | |
| H8N4 | A/Eurasian Wigeon/MPH571/08 | | | | 9.0 | | | |
| H3N2 | A/Brisbane/10/07 | 28.3 | 8.4 | | | | | |
| H3N2 | A/HK/1/68-MA | | | 29.6 | 29.6 | 29.6 | 20.9 | 20.9 |
| H3N2 | A/Wisconsin/67/05 | 28.3 | 10.0 | 12.4 | 20.9 | 29.6 | 29.6 | 83.6 |
| H4 | A/WF/HK/MPA892/06 | | | 9.3 | 6.6 | 2.8 | 3.3 | 2.8 |
| H7N3 | A/NIBRG/60 (A/mallard/Netherlands/12/00) | 28.3 | 8.4 | | | | | |
| H7N7 | A/PR8 H7N7-NY | 40.0 | 11.9 | 29.6 | 24.9 | 12.4 | 17.6 | 20.9 |
| H7N9 | A/Anhui/1/13 | | | | 144.2 | | 225.5 | |
| H7N9 | A/Shanghai/1/13 (R292K Tamiflu escape mutant) | | | | 147.8 | | | |

TABLE 37-continued

Average neutralization titers (nM) of heterodimeric Fc fusion constructs (empty cells mean 'not tested').

| | Virus strain | MD2622 | MD2623 | MD2643 | MD2644 | MD2645 | MD2646 | MD2647 |
|---|---|---|---|---|---|---|---|---|
| H7N9 | A/Shanghai/2/13 | | | | 60.6 | | 61.3 | |
| H10N7 | A/Chick/Germany/N/49 | | | 22.2 | 15.7 | 6.6 | 5.5 | 11.1 |
| Victoria | B/Malaysia/2506/04 | | | 12.4 | 7.4 | 8.8 | 7.4 | 29.6 |
| Yamagata | B/Florida/04/06 | | | 2.8 | 2.8 | 2.8 | 3.3 | 22.2 |
| Yamagata | B/Harbin/7/94 | | | 5.2 | 4.4 | 3.7 | 3.7 | 35.2 |

Functional Fc-Receptor Binding (Antibody Dependent Cellular Cytotoxicity)

Functional binding to cell expressed human FcγRIIIa (CD16a) was measured using an ADCC (antibody dependent cellular cytotoxicity) Reporter Bioassay (Promega). Target A549 cells were infected with B/Brisbane/60/2008 or B/Florida/04/2006, or transfected with a plasmid encoding H3N2 A/Wisconsin/67/2005 HA using Lipofectamine 2000 (Invitrogen) in OPTI-MEM I (Gibco). After 24 hours, HA expressing target cells were seeded into white 96-wells plates and incubated for 30 min with serial dilutions of Fc fusion constructs or IgG control antibodies. As additional negative controls constructs bearing the LALA point mutations in the Fc-fragment were used. The LALA point mutations (L234A, L235A as described by Hessel et al. 2007) show significantly reduced binding to human Fcγ receptors and induction of ADCC. Last, Jurkat effector T-cells (stably expressing FcγRIIIa V158 and NFAT-RE Luciferase) were added to the target cells and incubated for 6 h. Bio-Glo Luciferase Assay Substrate solution (Promega) was added to the wells and luminescence (in RLUs) was measured with a luminescence plate reader (Perkin Elmer). RLU data were fitted using a standard four parameter logistic nonlinear regression model in SPSS.

All SD/MD Fc-fusion constructs (except for the LALA versions) show robust induction of ADCC indicating that binding to the stem epitopes on influenza HA at the surface of cells allows for productive interaction with FcγRIIIa receptor expressing cells. Results are summarized in Table 38.

TABLE 38

Functional Fc-receptor binding (ADCC induction).

| | ADCC induction | | |
|---|---|---|---|
| Construct | A/Wisconsin/ 67/2005 | B/Brisbane/ 60/2008 | B/Florida/ 04/2006 |
| MD2606 | | − | − |
| MD2608 | | ++ | ++ |
| MD2610 | | + | + |
| MD2407 | | − | − |
| MD3606 | ++ | ++ | ++ |
| MD3607 | + | − | − |
| CR9114 (+control mAb) | ++ | ++ | ++ |
| CR9114-LALA | − | − | − |
| CRJB (−control mAb) | − | − | − |

"++" refers to an $EC_{50}$ <0.1 µg/mL,
"+" refers to an $EC_{50}$ <0.5 µg/mL,
"−" refers to an $EC_{50}$ >0.5 µg/mL,
empty cells mean 'not tested'.

Fusing sdAbs or sdAb multimers to the Fc fragment of human IgG1 results in HA binding molecules which preserve the potency and breadth of neutralization of the used individual sdAb or multi-domain building blocks. The sdAb building blocks can be fused to the N- as well as the C-terminus of the Fc fragment. During expression two Fc chains form a bivalent antibody-like molecule. It is therefore also possible to express in the same cell two different Fc chain constructs varying in their sdAb or multi-domain part and to create a bispecific antibody-like molecule. Homodimeric and heterodimeric Fc fusion constructs with sdAb and/or multi-domains attached to the N- and/or C-terminus of the Fc fragment have been successfully created and their breadth in neutralization spanning influenza A and B demonstrated. In addition to direct neutralization by the sdAb or multi-domain part, the Fc part of the fusion construct, when bound to HA at the surface of infected or transfected cells, can promote productive interaction with FcγRIIIa (CD16a) receptors at the surface of effector cells. This can in vivo lead to activation of NK cells and subsequent to induction of ADCC. Next to the induction of effector functions the Fc portion can also interact with neonatal Fc receptor resulting in prolonged in vivo half-life.

Example 10: In Vivo Efficacy of Single Domain and Multi-Domain Antibodies

In Vivo Efficacy of Influenza a Group 1 Single Domain Antibodies

Figure 2:
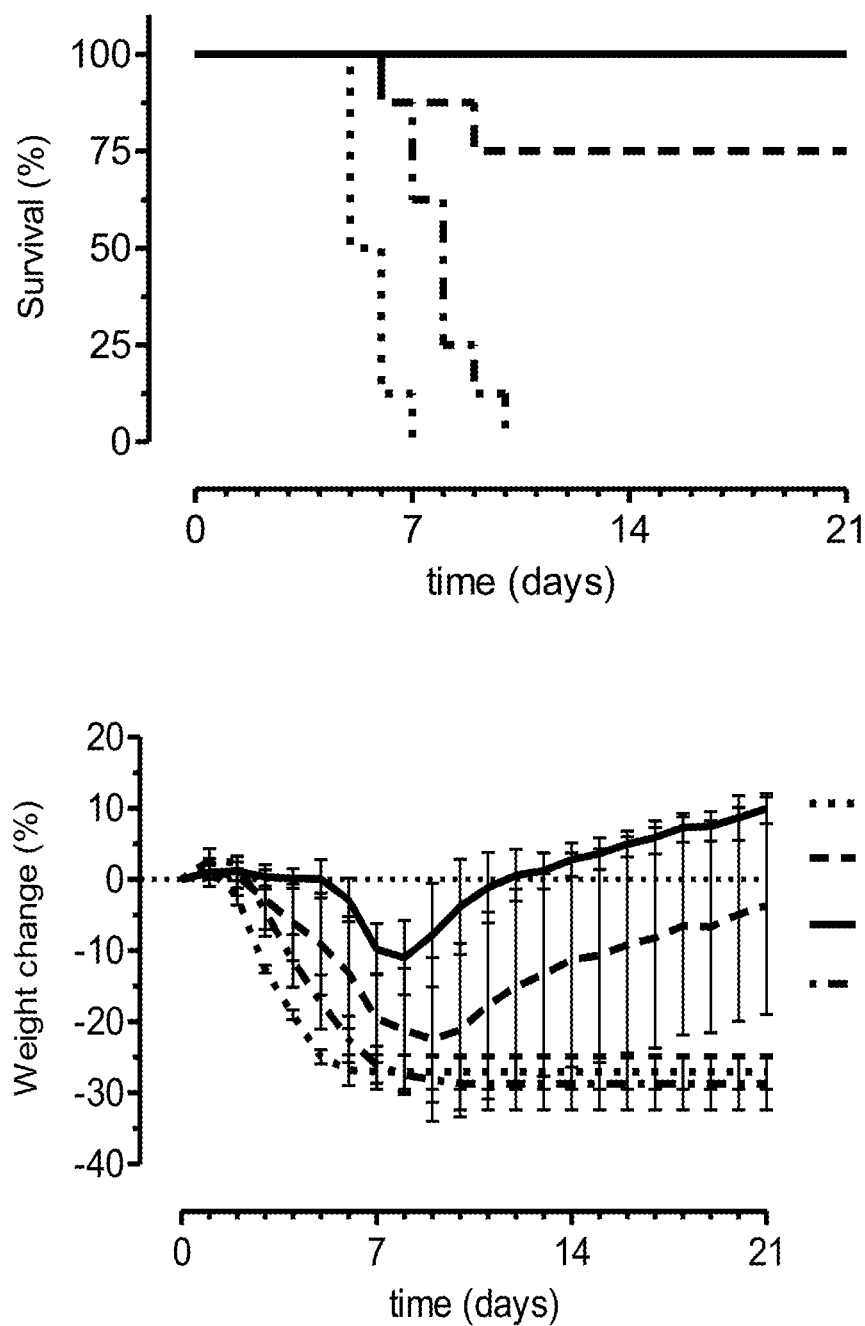
FIG. 2 shows the in vivo efficacy of SD1016, SD1038 and SD1045 against a lethal challenge with A/Puerto Rico/8/1934-MA (H1N1) virus. Survival curves (top) and weight loss (bottom) of mice treated with 0.5 mg/kg sdAb one day before challenge (at day 0) are shown.

The exemplary influenza A group 1 single domain antibodies SD1016, SD1038 and SD1045 were selected for in vivo influenza neutralization studies using Balb/C mice. Briefly, 6-8 week old female Balb/C mice (n=8) were dosed intranasally with SD1016, SD1038 or SD1045 at a single dose of 0.5 mg/kg. Another group of 8 mice receiving buffer solution only served as a vehicle control group. One day post-administration mice were challenged intranasally with 25×$LD_{50}$ of influenza strain A/Puerto Rico/8/1934-MA (H1N1). Survival and body weight were monitored for 21 days after infection. Administration of both SD1038 and SD1016 resulted in a statistically significant improvement in survival proportion compared to the vehicle control group whereas administration of SD1045 only resulted in an improvement in survival time (see FIG. 2).

In Vivo Efficacy of Influenza a Group 2 Single Domain Antibodies

Figure 3:
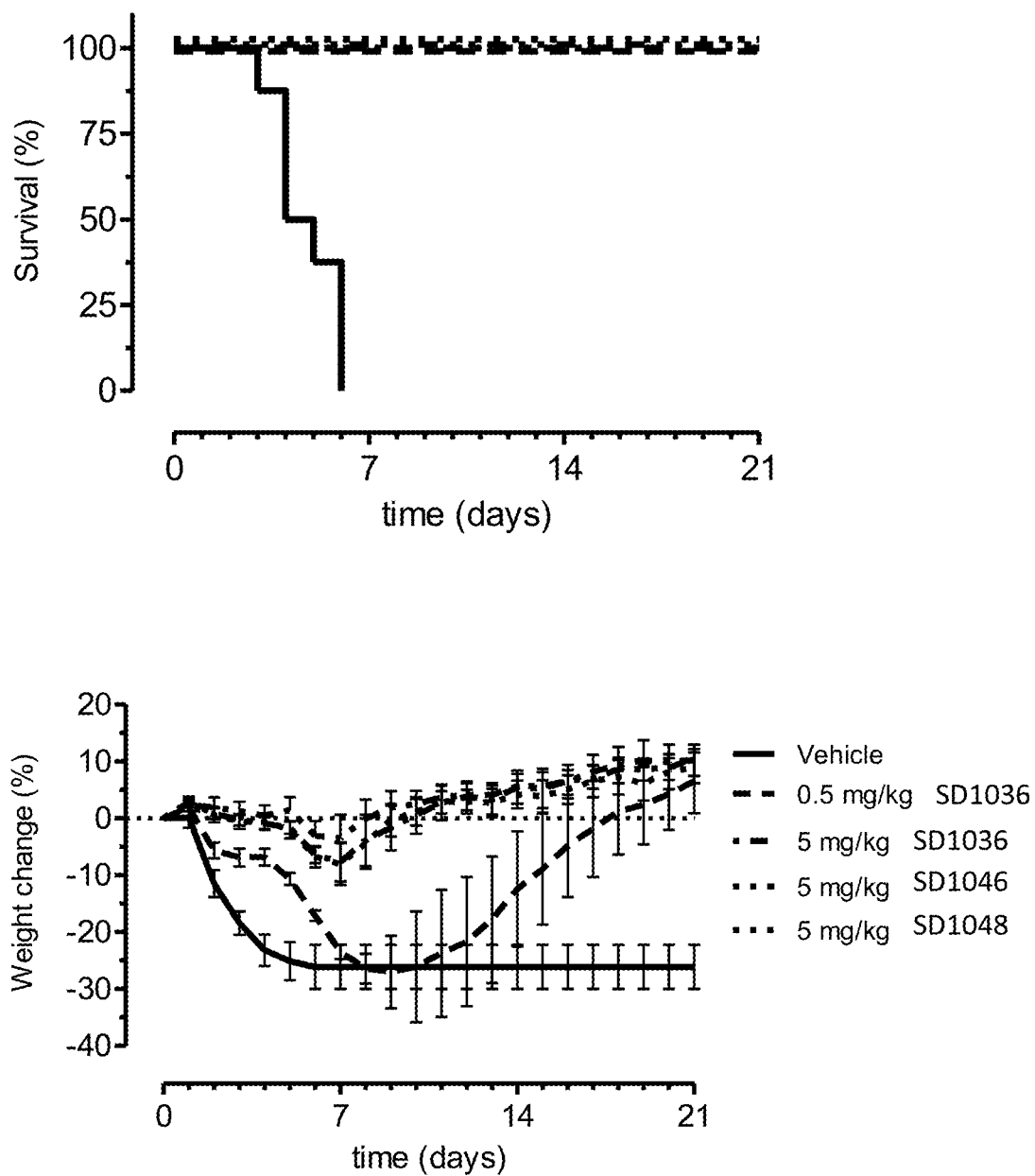
FIG. 3 shows the in vivo efficacy of SD1036, SD1046 and SD1048 against a lethal challenge with A/Hong Kong/1/1968-MA (H3N2) virus. Survival curves (top) and weight loss (bottom) of mice treated with 5 or 0.5 mg/kg sdAb one day before challenge (at day 0) are shown.
Figure 4:
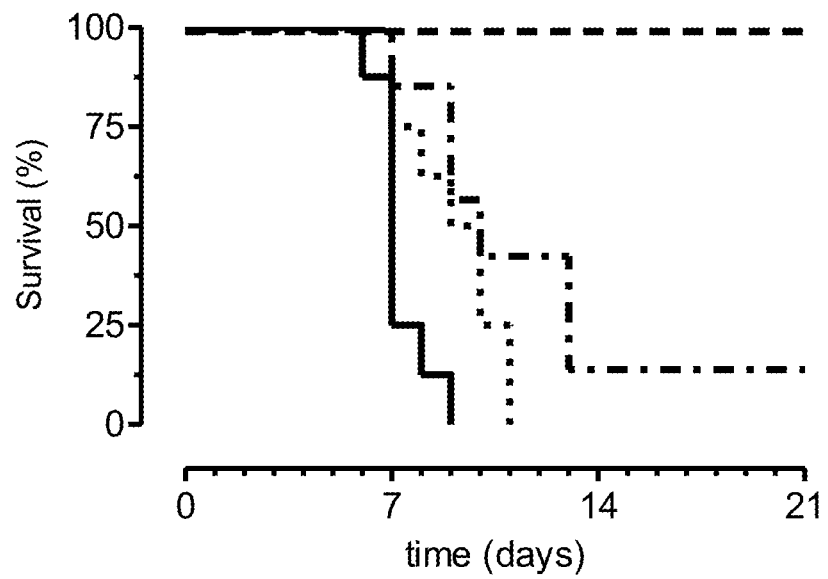
FIG. 4 shows the in vivo efficacy of SD1083 and SD1084 against a lethal challenge with B/Florida/4/2006 virus. Survival curves (top) and weight loss (bottom) of mice treated with 5 or 0.5 mg/kg sdAb one day before challenge (at day 0) are shown.
Figure 4:
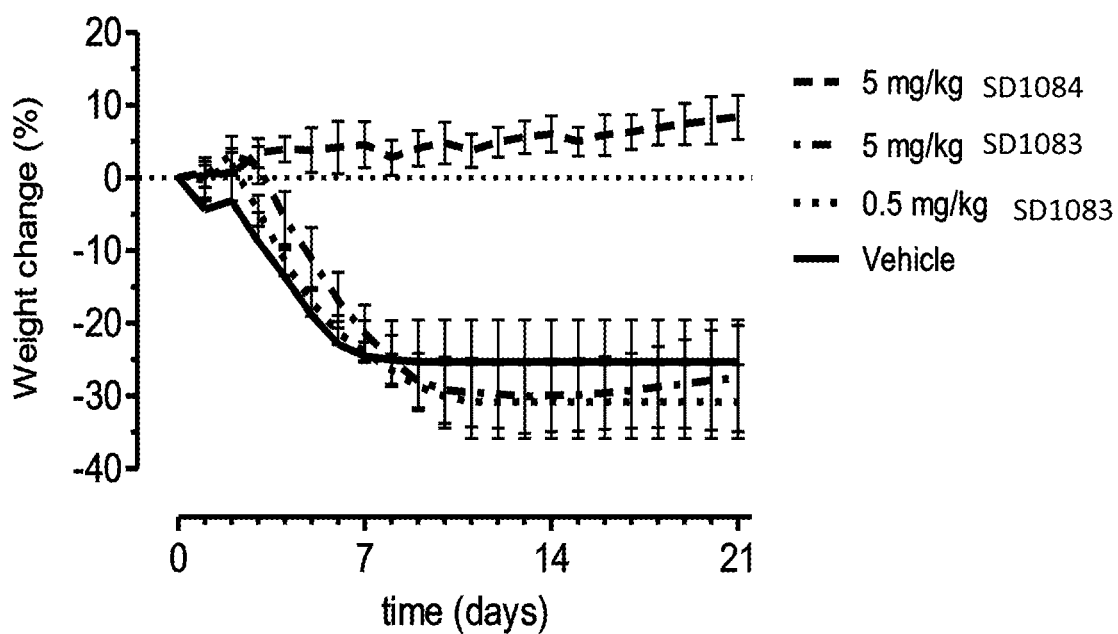
Figure 5:
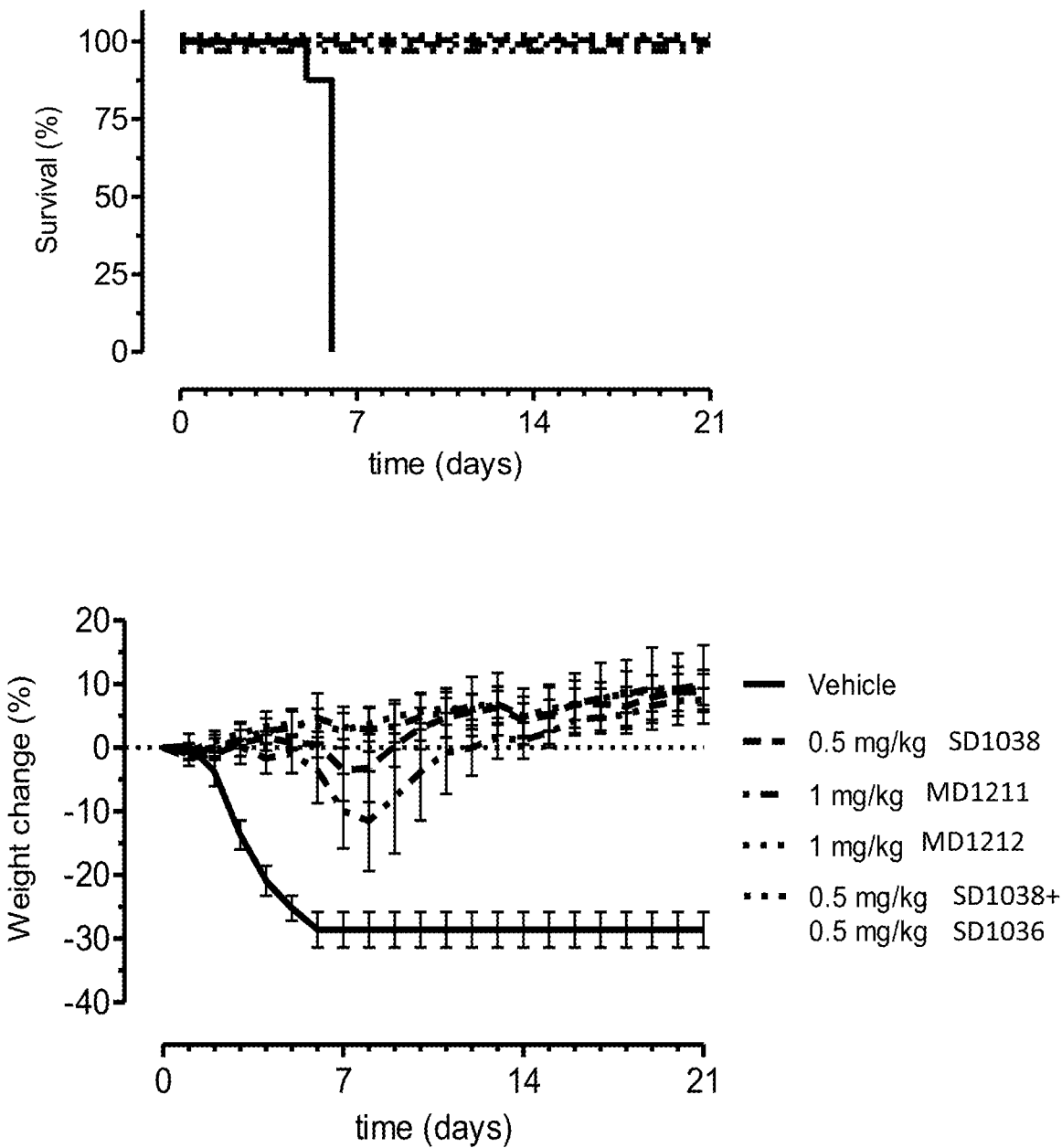
FIG. 5 shows the in vivo efficacy of SD1038, MD1211, MD1212 or a 1:1 mixture of SD1038 and SD1036 against a lethal challenge with A/Puerto Rico/8/1934-MA (H1N1) virus. Survival curves (top) and weight loss (bottom) of mice treated with single or multi-domain antibody one day before challenge (at day 0) are shown.
Figure 6:
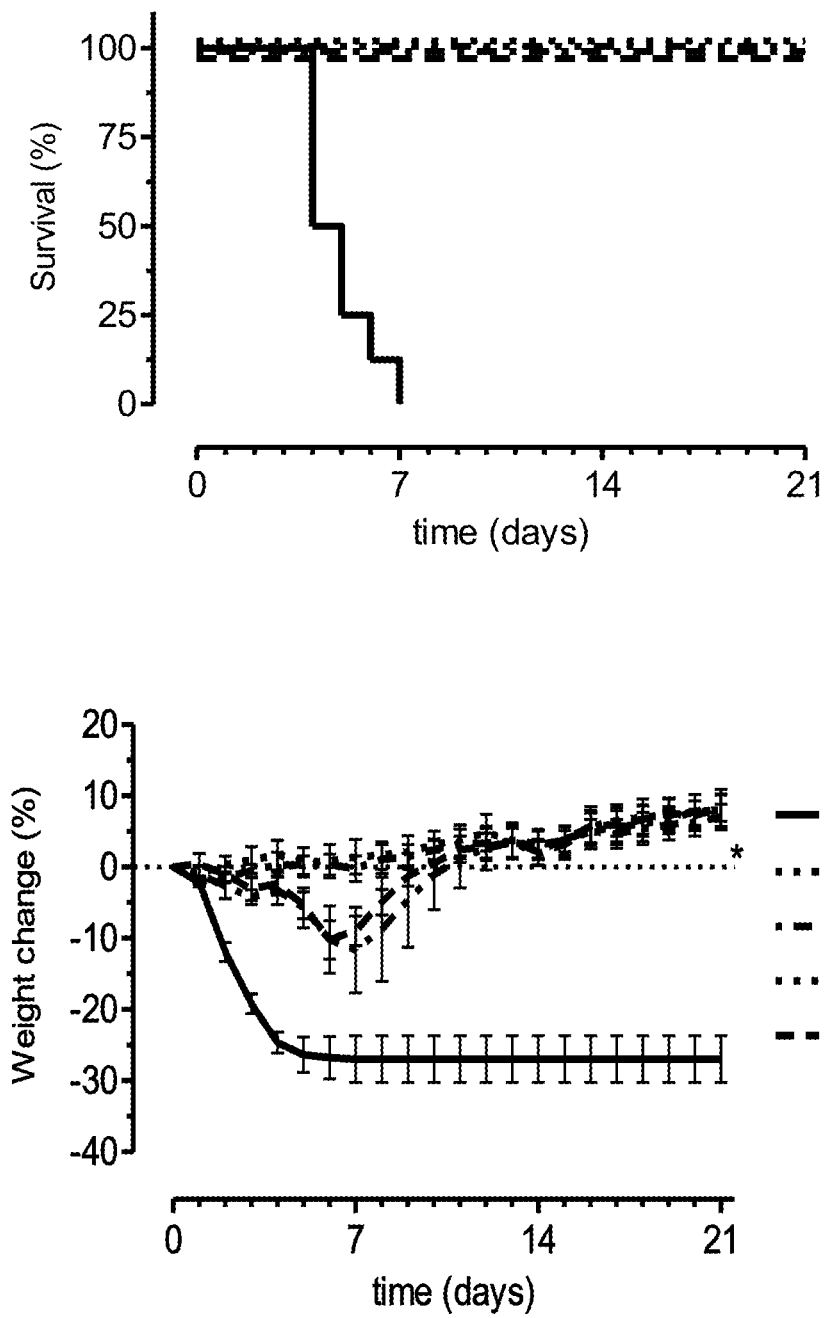
FIG. 6 shows the in vivo efficacy of SD1036, MD1211, MD1212 or a 1:1 mixture of SD1036 and SD1038 against a lethal challenge with A/Hong Kong/1/1968-MA (H3N2) virus. Survival curves (top) and weight loss (bottom) of mice treated with single or multi-domain antibody one day before challenge (at day 0) are shown.
Figure 7A:
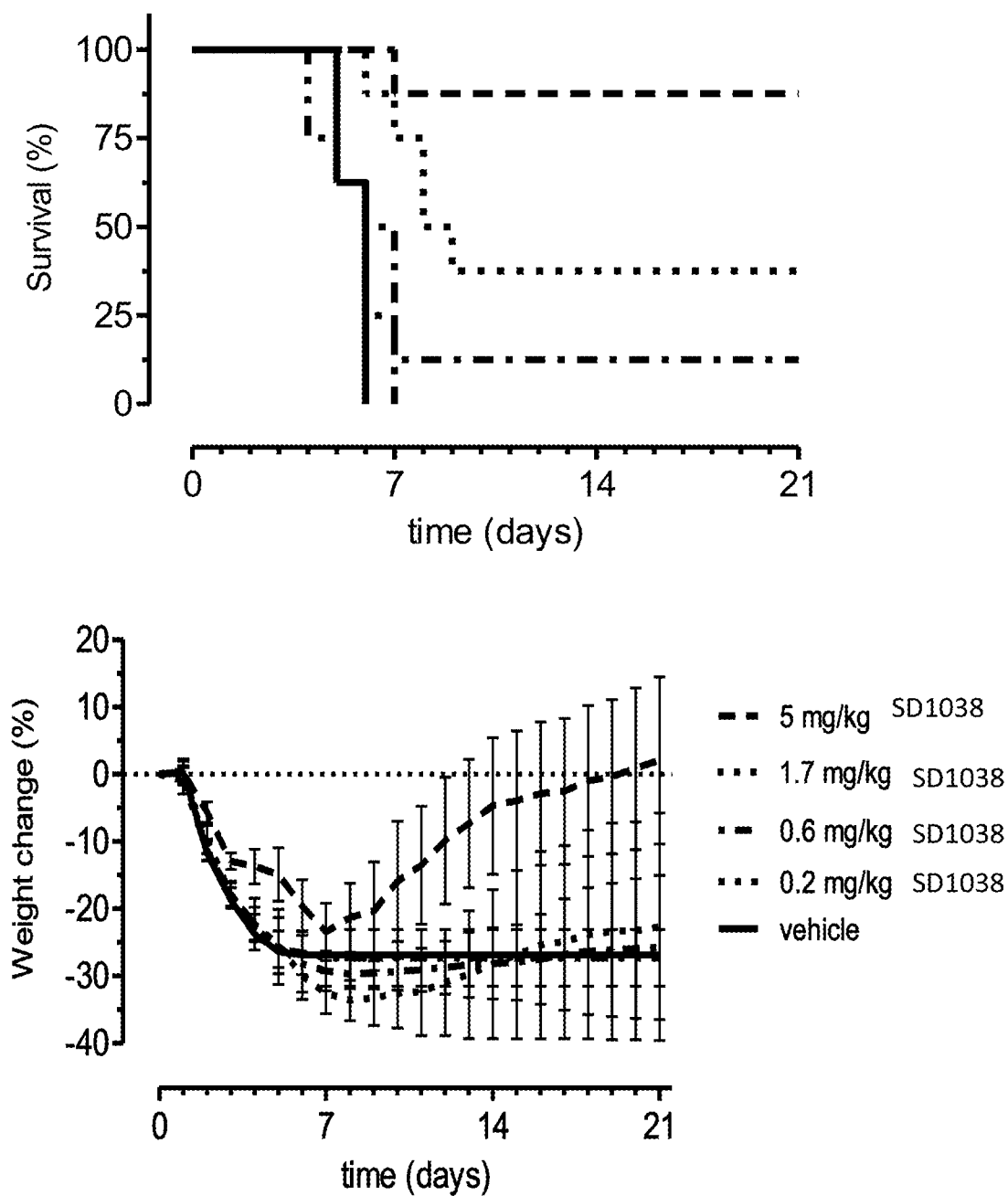
FIGS. 7A-7B show the in vivo efficacy of SD1038 and MD1212 against a lethal challenge with A/Hong Kong/1/1968-MA (H3N2) virus. Survival curves (top) and weight loss (bottom) of mice treated with 5, 1.7, 0.6 or 0.2 mg/kg single or multi-domain antibody one day before challenge (at day 0) are shown.
Figure 7B:
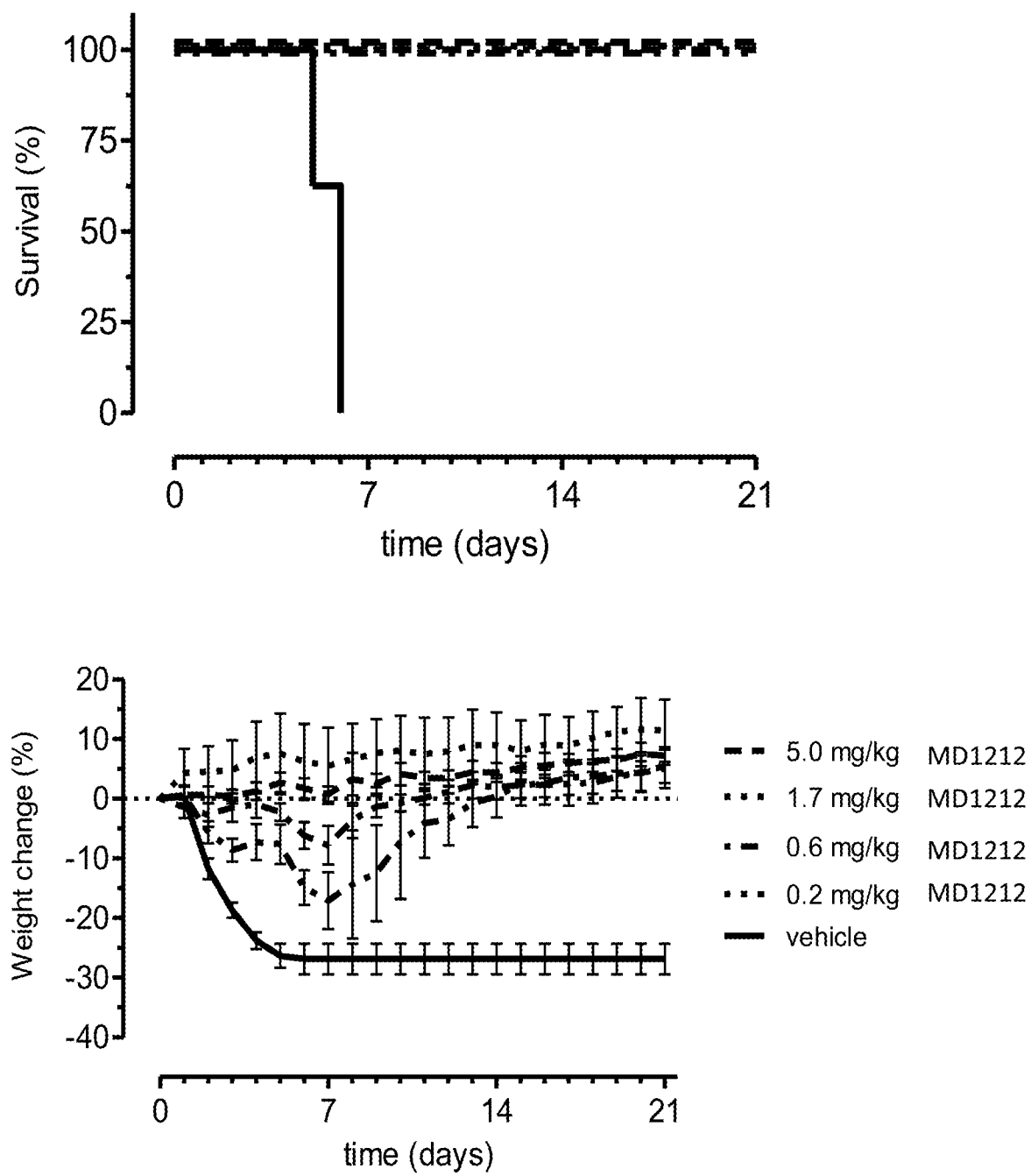
Figure 8:
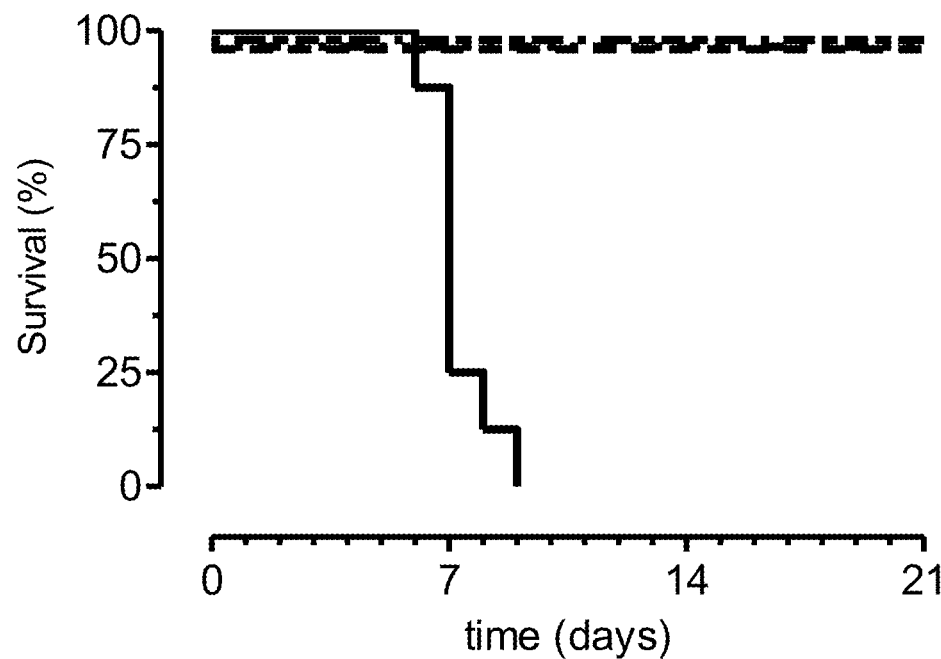
FIG. 8 shows the in vivo efficacy of MD1221, MD1222 and MD1224 against a lethal challenge with B/Florida/4/2006 virus. Survival curves (top) and weight loss (bottom) of mice treated with 5 or 0.5 mg/kg multi-domain antibody one day before challenge (at day 0) are shown.
Figure 8:
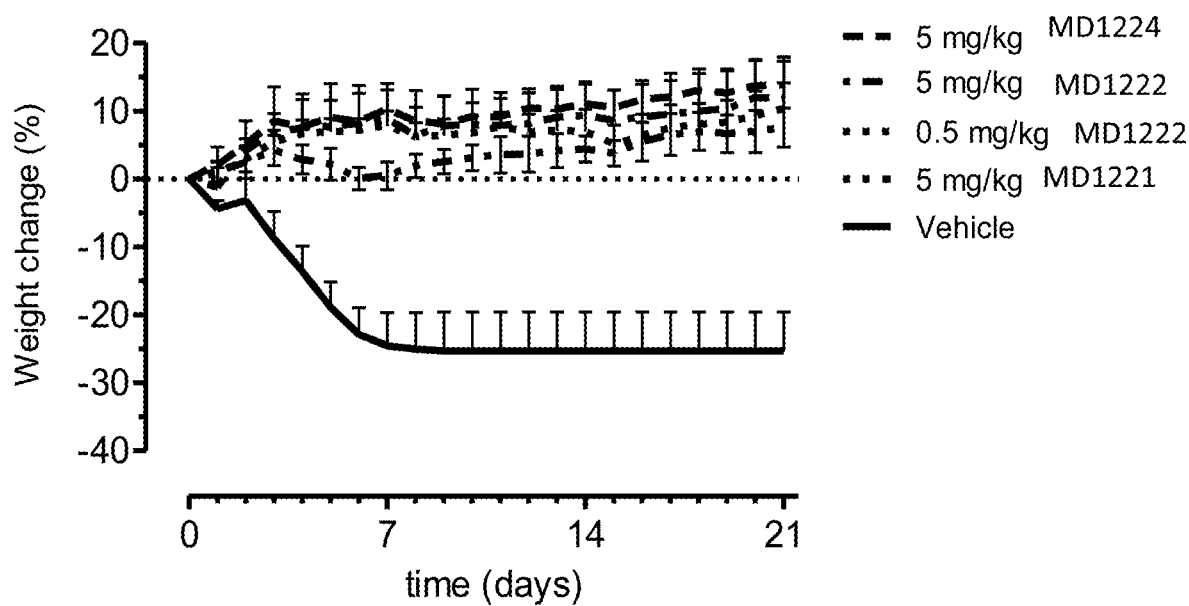
Figure 9:
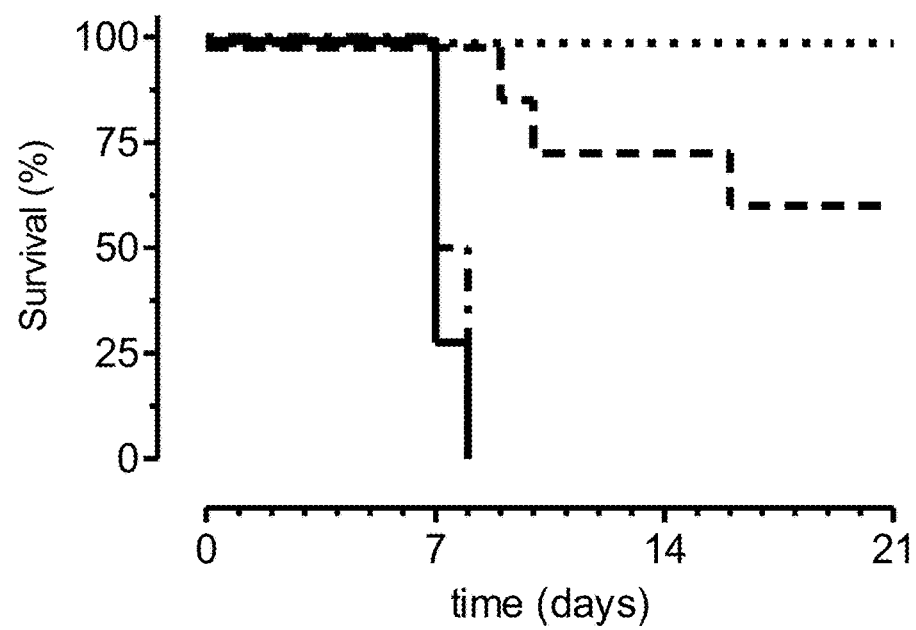
FIG. 9 shows the in vivo efficacy of MD1301, MD2601 and CR9114 against a lethal challenge with A/Puerto Rico/8/1934-MA (H1N1) virus. Survival curves (top) and weight loss (bottom) of mice treated with 3 mg/kg (multi-domain) antibody one day before challenge (at day 0) are shown.
Figure 9:
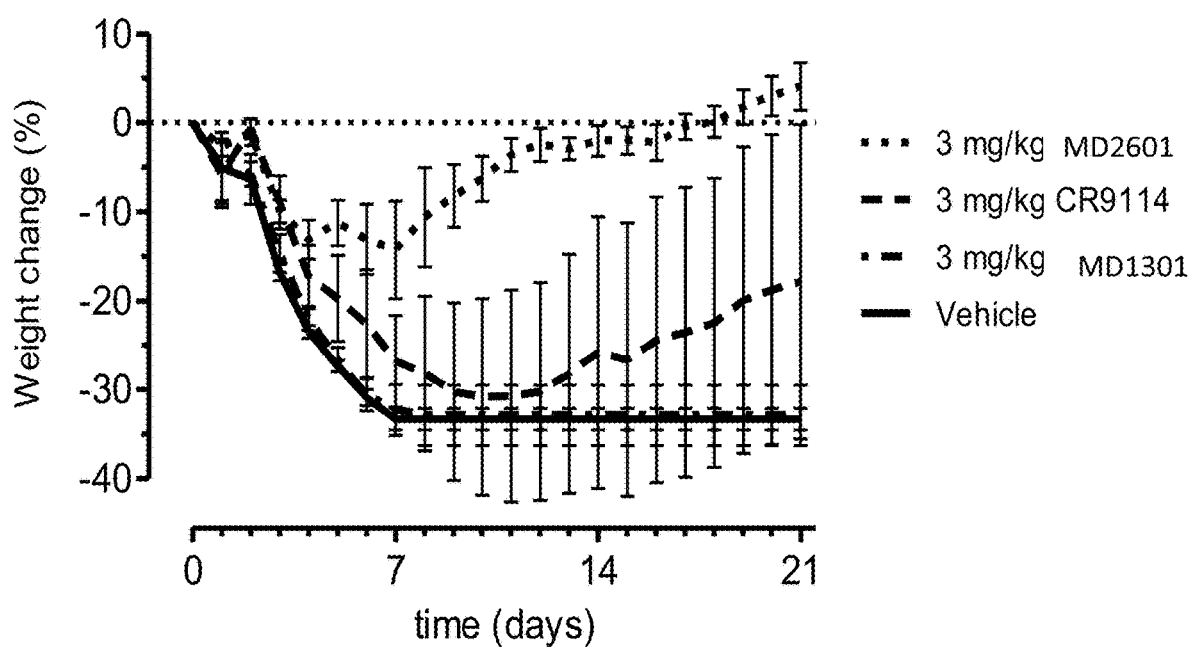
Figure 10A:
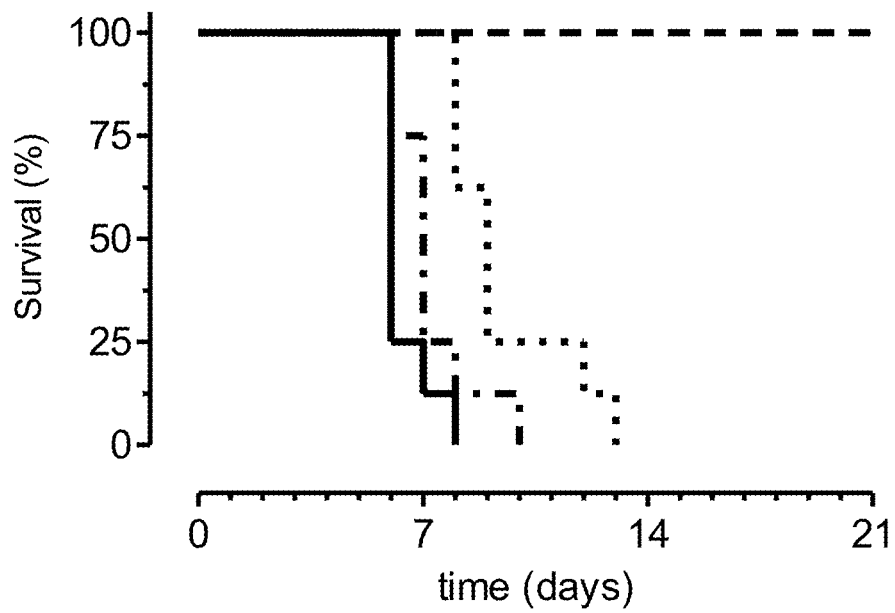
FIGS. 10A-10C show the in vivo efficacy of MD1301, MD2601 and CR9114 against a lethal challenge with A/Puerto Rico/8/1934-MA (H1N1) virus. Survival curves (top) and weight loss (bottom) of mice treated with 0.2, 0.05 or 0.01 mg/kg (multi-domain) antibody one day before challenge (at day 0) are shown.
Figure 10A:
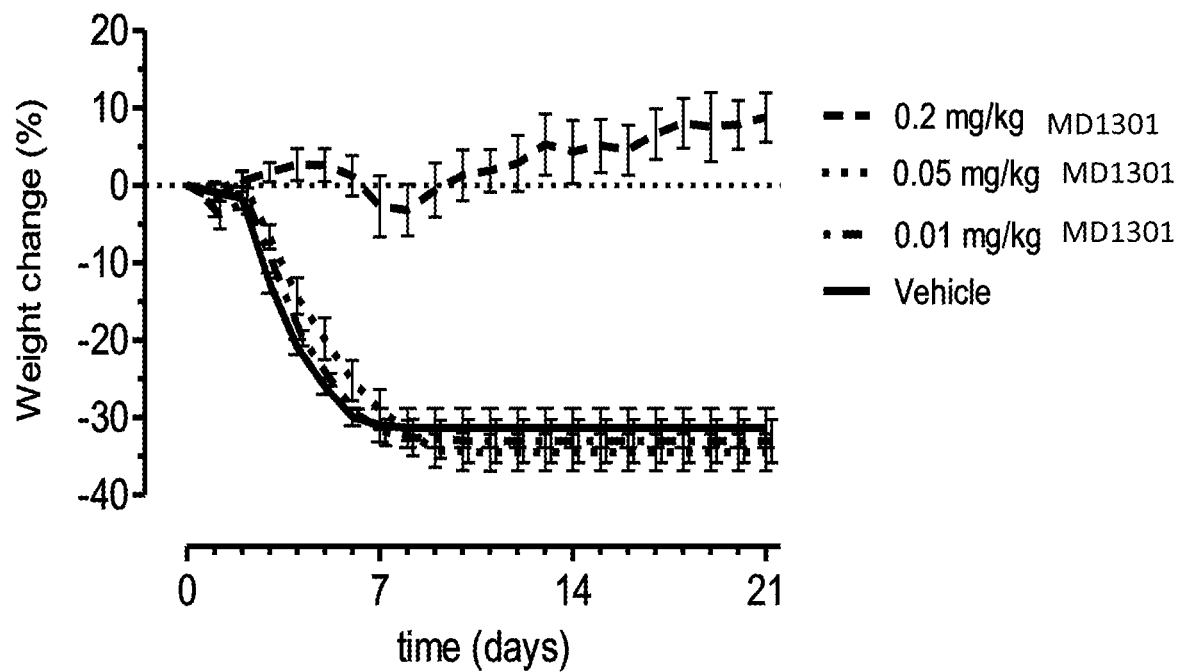
Figure 10B:
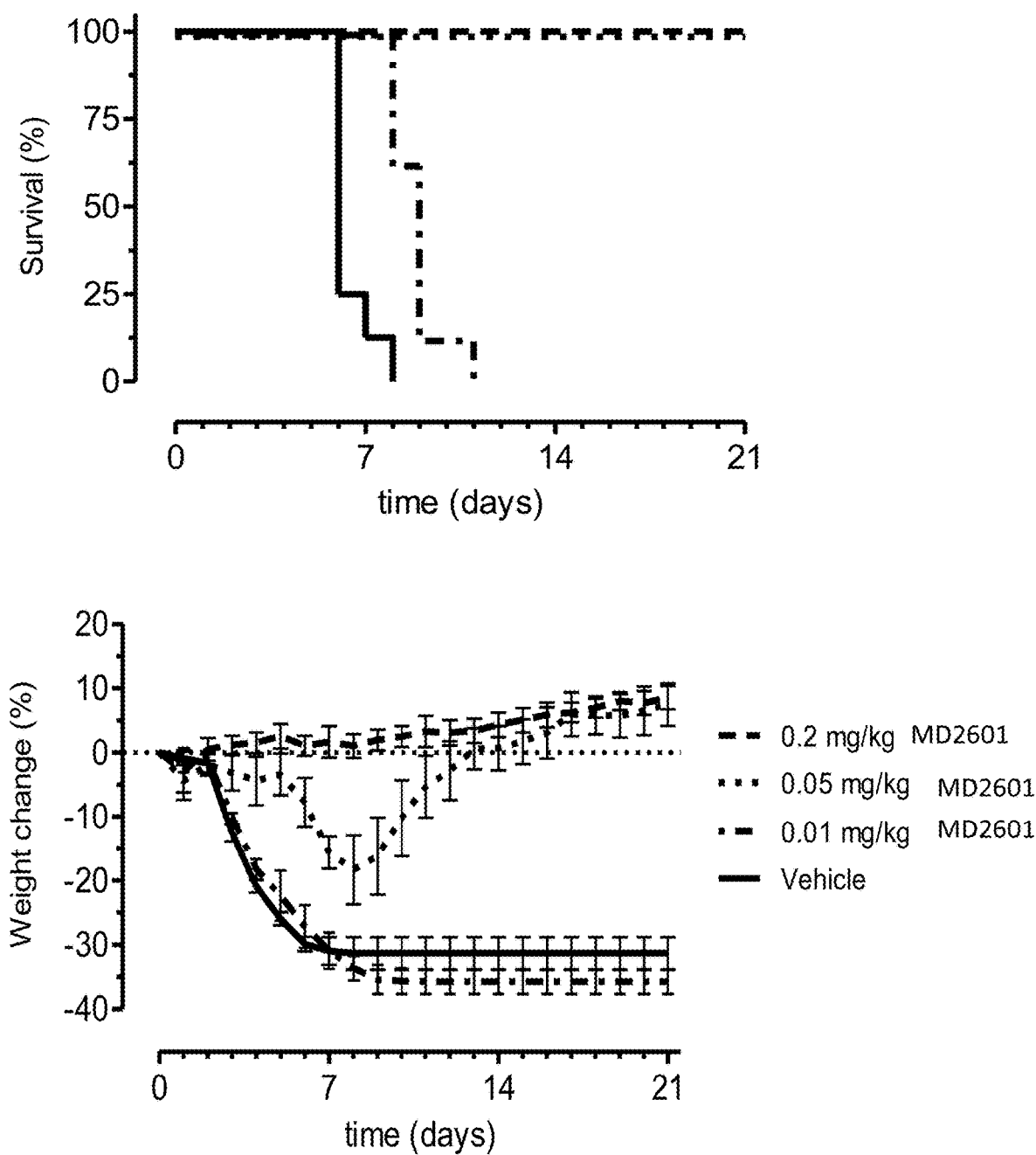
Figure 10C:
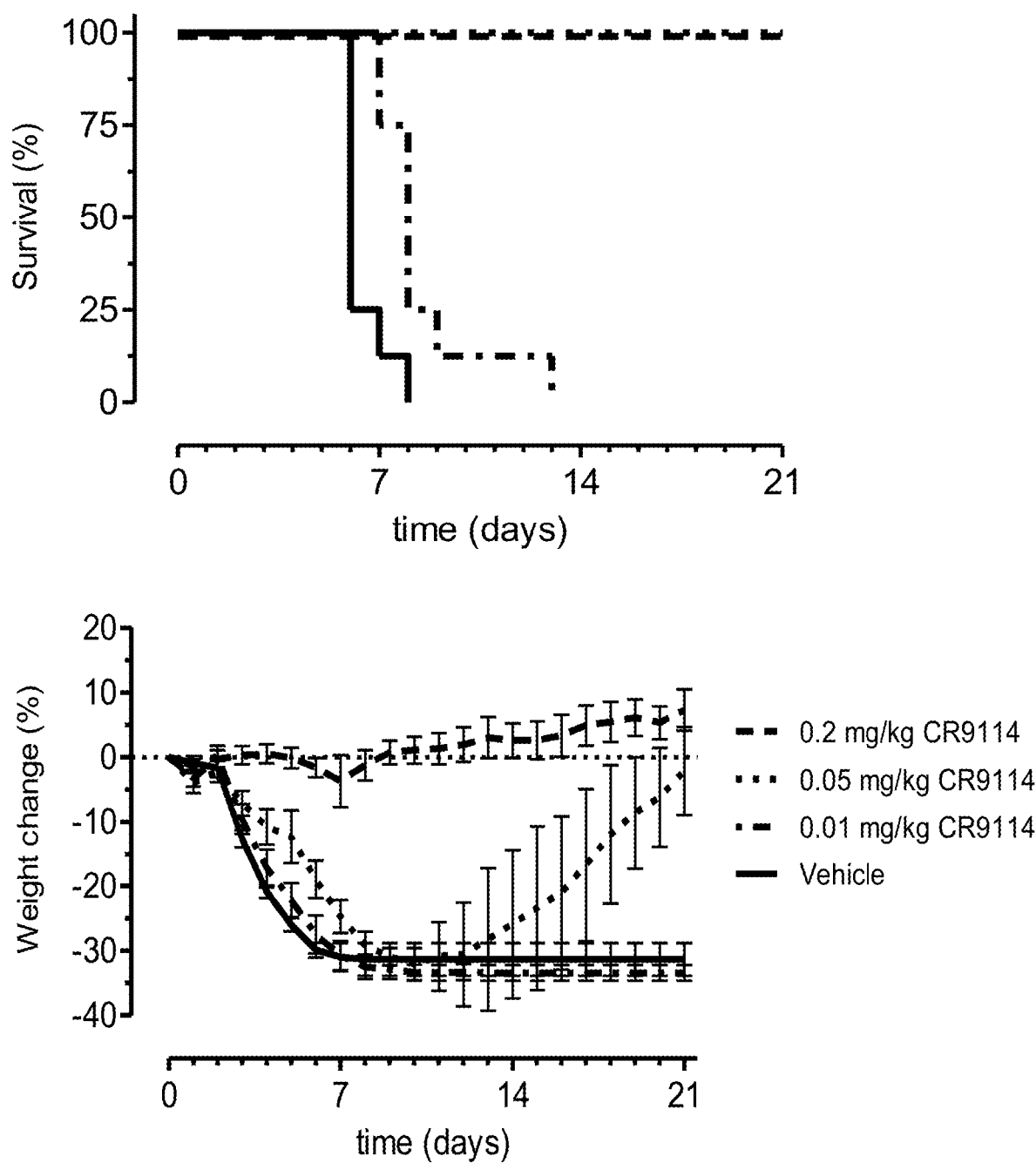

The exemplary influenza A group 2 single domain antibodies SD1036, SD1046 and SD1048 were selected for in vivo influenza neutralization studies using Balb/C mice. Briefly, 6-8 week old female Balb/C mice (n=8) were dosed intranasally with SD1046 or SD1048 at a dose of 5 mg/kg or with SD1036 at 2 doses (0.5 mg/kg or 5 mg/kg). Another group of 8 mice receiving buffer solution only served as a vehicle control group. One day post-administration mice were challenged intranasally with 25×LD50 of influenza strain A/Hong Kong/1/1968-MA (H3N2). Survival and body weight were monitored for 21 days after infection. This study shows that intranasal administration of SD1036, SD1046 or SD1048 provides full protection against a lethal challenge of A/Hong Kong/1/1968-MA virus (see FIG. 3).

In Vivo Efficacy of Influenza B Single Domain Antibodies

The exemplary influenza B single domain antibodies SD1083 and SD1084 were selected for in vivo influenza neutralization studies using Balb/C mice. Briefly, 6-8 week old female Balb/C mice (n=8) were dosed intranasally with SD1084 at a single dose of 5 mg/kg or with SD1083 at 2 doses (0.5 mg/kg or 5 mg/kg). Another group of 8 mice receiving buffer solution only served as a vehicle control group. One day post-administration mice were challenged intranasally with 25×LD50 of influenza strain B/Florida/4/2006. Survival and body weight were monitored for 21 days after infection. This study shows that sdAb SD1084 provide 100% protection against a lethal challenge with B/Florida/4/2006, whereas SD1083 only provides partial protection at the highest dose of 5 mg/kg. The lower dose of SD1083 only resulted in an improvement in survival time (FIG. 4).

In Vivo Efficacy of Influenza a Single and Multi-Domain Antibodies in H1N1 Model The exemplary influenza A sdAb SD1038 and the exemplary influenza A multi-domain antibodies MD1211 and MD1212 were selected for in vivo influenza neutralization studies using Balb/C mice. Briefly, 6-8 week old female Balb/C mice (n=8) were dosed intranasally with MD1211 or MD1212 at a dose of 1 mg/kg or with SD1038 either alone (0.5 mg/kg) or mixed 1:1 with SD1036 (total dose=1 mg/kg). Another group of 8 mice receiving buffer solution only served as a vehicle control group. One day post-administration mice were challenged intranasally with 25×LD50 of influenza strain A/Puerto Rico/8/1934-MA (H1N1). Survival and body weight were monitored for 21 days after infection. This study shows that intranasal administration of SD1038, MD1211, MD1212 or a 1:1 mixture of SD1038 and SD1036 provides full protection against a lethal challenge of A/Puerto Rico/8/1934-MA virus. The body weight curves indicate that the efficacy of MD1211 and MD1212 is superior to that of the sdAb (mixture) (FIG. 5).

In Vivo Efficacy of Influenza a Single and Multi-Domain Antibodies in H3N2 Model The exemplary influenza A sdAb SD1036 and the exemplary influenza A multi-domain antibodies MD1211 and MD1212 were selected for in vivo influenza neutralization studies using Balb/C mice. Briefly, 6-8 week old female Balb/C mice (n=8) were dosed intranasally with MD1211 or MD1212 at a dose of 5 mg/kg or with SD1036 either alone (2.5 mg/kg) or mixed 1:1 with SD1038 (total dose=5 mg/kg). Another group of 8 mice receiving buffer solution only served as a vehicle control group. One day post-administration mice were challenged intranasally with 25×LD50 of influenza strain A/Hong Kong/1/1968-MA (H3N2). Survival and body weight were monitored for 21 days after infection. This study shows that intranasal administration of SD1036, MD1211, MD1212 or a 1:1 mixture of SD1036 and SD1038 provides full protection against a lethal challenge of A/Hong Kong/1/1968-MA virus. The body weight curves indicate that the efficacy of MD1211 and MD1212 is superior to that of the sdAb (mixture) (FIG. 6).

Comparison of In Vivo Efficacy of SD1038 Monomer and Dimer in H3N2 Model

The exemplary influenza A single domain antibody SD1038 and the exemplary influenza A multi-domain antibody MD1212 were selected for in vivo influenza neutralization studies using Balb/C mice. Briefly, 6-8 week old female Balb/C mice (n=8) were dosed intranasally with SD1038 or MD1212 at 4 doses (5 mg/kg, 1.7 mg/kg, 0.6 mg/kg or 0.2 mg/kg). Another group of 8 mice receiving buffer solution only served as a vehicle control group. One day post-administration mice were challenged intranasally with 25×LD50 of influenza strain A/Hong Kong/1/1968-MA (H3N2). Survival and body weight were monitored for 21 days after infection. This study shows that SD1038 only provides partial protection against a lethal challenge of A/Hong Kong/1/1968-MA virus and that the level of protection is dose-dependent. In contrast, dimeric SD1038 (MD1212) provides 100% protection in all 4 dose groups (FIGS. 7A-7B).

In Vivo Efficacy of Influenza B Multi-Domain Antibodies

The exemplary influenza B multi-domain antibodies MD1221, MD1222 and MD1224 were selected for in vivo influenza neutralization studies using Balb/C mice. Briefly, 6-8 week old female Balb/C mice (n=8) were dosed intranasally with MD1221 or MD1224 at a single dose of 5 mg/kg or MD1222 at 2 doses (0.5 mg/kg or 5 mg/kg). Another group of 8 mice receiving buffer solution only served as a vehicle control group. One day post-administration mice were challenged intranasally with 25×LD50 of influenza strain B/Florida/4/2006. Survival and body weight were monitored for 21 days after infection. This study shows that all 3 multi-domain antibodies provide 100% protection against a lethal challenge with B/Florida/4/2006 (FIG. 8).

In Vivo Efficacy of Influenza A & B Multi-Domain Antibodies Against H1N1 after i.v. Administration The exemplary influenza A & B multi-domain antibodies MD1301 and MD2601 were selected for in vivo influenza neutralization studies using Balb/C mice. Briefly, 6-8 week old female Balb/C mice (n=8) were dosed intravenously with MD1301 or MD2601 at a single dose of 3 mg/kg. CR9114 was taken along as positive control. Another group of 8 mice receiving buffer solution only served as a vehicle control group. One day post-administration mice were challenged intranasally with 25×LD50 of influenza strain A/Puerto Rico/8/1934-MA (H1N1). Survival and body weight were monitored for 21 days after infection. This study shows that the Fc-containing multi-domain antibody MD2601 provides full protection after i.v. administration while Fc-less MD1301 has no effect on survival. Control antibody CR9114 only provides partial protection against a lethal challenge with A/Puerto Rico/8/1934-MA (H1N1) (FIG. 9).

In Vivo Efficacy of Influenza A & B Multi-Domain Antibodies Against H1N1 after i.n. Administration The exemplary influenza A & B multi-domain antibodies MD1301 and MD2601 and reference antibody CR914 were selected for in vivo influenza neutralization studies using Balb/C mice. Briefly, 6-8 week old female Balb/C mice (n=8) were dosed intranasally with MD1301, MD2601 or reference antibody CR9114 at 3 doses (0.2, 0.05 or 0.01 mg/kg). Another group of 8 mice receiving buffer solution only served as a vehicle control group. One day post-administration mice were challenged intranasally with 25×LD50 of influenza strain A/Puerto Rico/8/1934-MA (H1N1). Survival and body weight were monitored for 21 days after infection. This study shows that the minimum effective dose (defined as the lowest dose providing 100% protection) is 0.05 mg/kg for the Fc-containing antibodies MD2601 and CR9114 and 0.2 mg/kg for Fc-less MD1301. Mice receiving 0.05 mg/kg CR9114 showed a larger drop in body weight than mice receiving the same dose of MD2601 (FIGS. 10A-10C).

In Vivo Efficacy of Influenza A & B Multi-Domain Antibody MD2617 Against H1N1

Figure 11A:
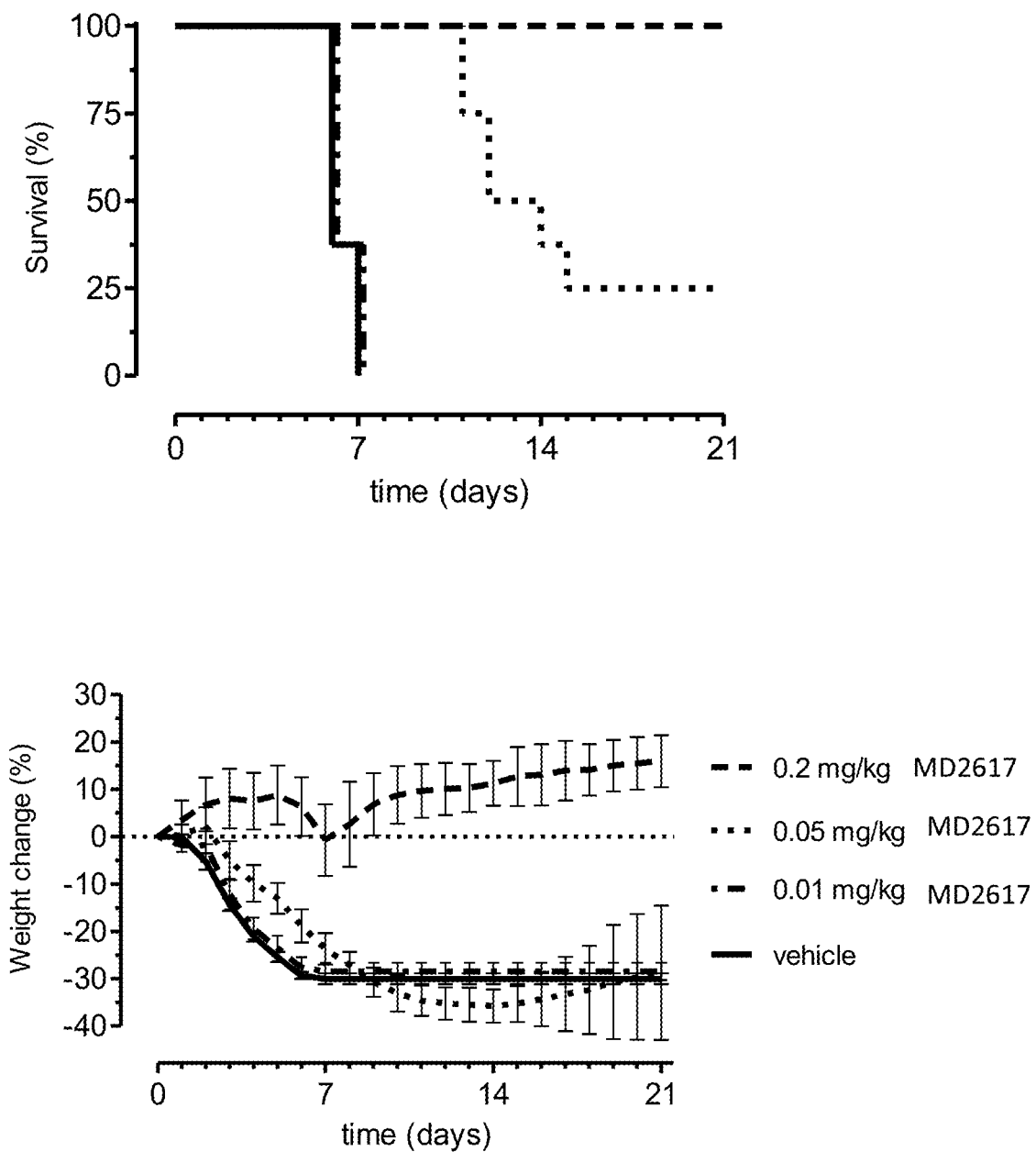
FIGS. 11A-11B show the in vivo efficacy of MD2617 against a lethal challenge with A/Puerto Rico/8/1934-MA (H1N1) virus. Survival curves (top) and weight loss (bottom) of mice treated intranasally (TOP) or intravenously (BOTTOM) with MD2617 one day before challenge (at day 0) are shown.
Figure 11B:
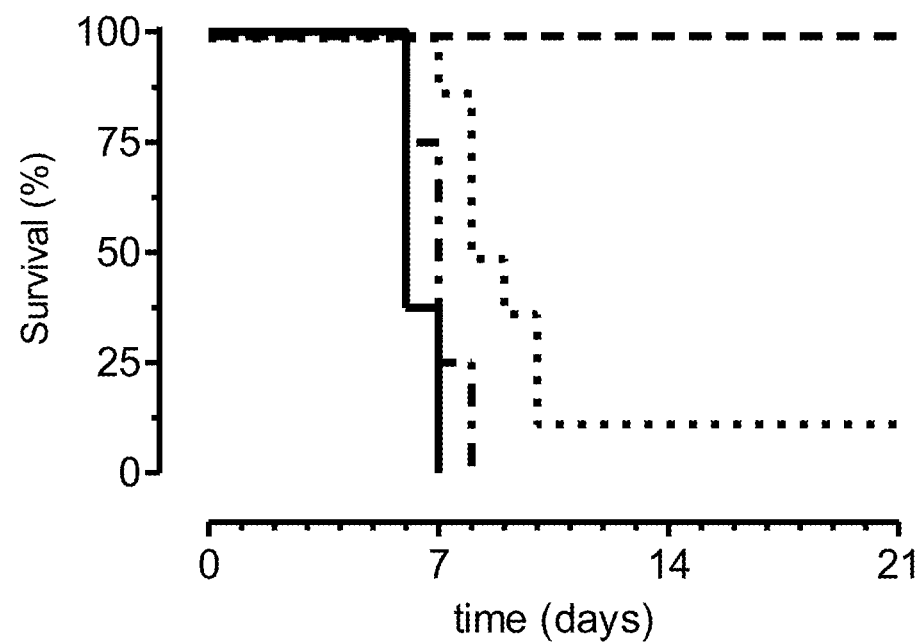
Figure 11B:
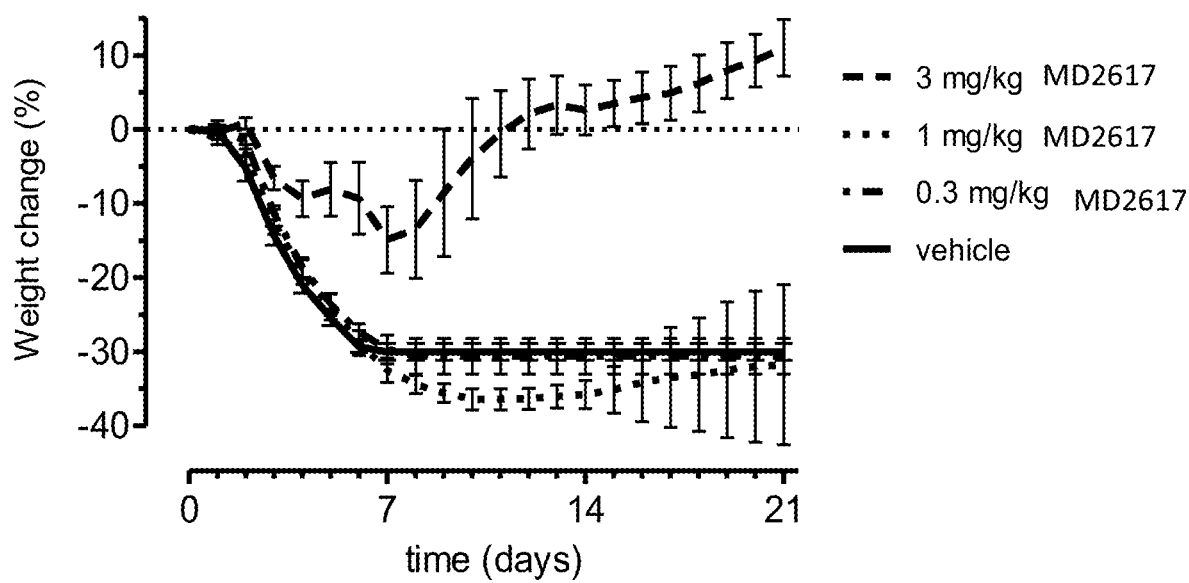
Figure 12A:
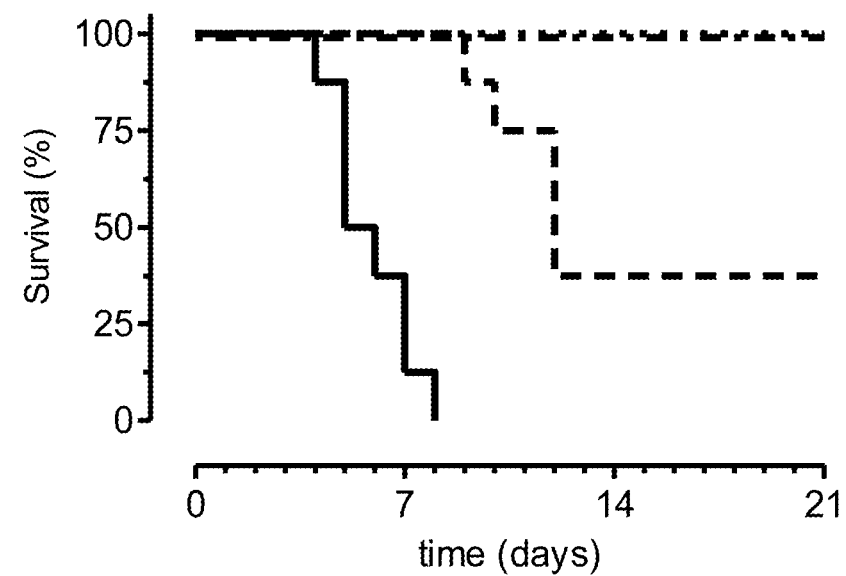
FIGS. 12A-12B show the in vivo efficacy of MD2617 and CR9114 against a lethal challenge with B/Florida/4/2006 (TOP) or A/Hong Kong/1/1968-MA (BOTTOM) virus. Survival curves (top) and weight loss (bottom) of mice treated intranasally or intravenously with (multi-domain) antibody one day before challenge (at day 0) are shown.
Figure 12A:
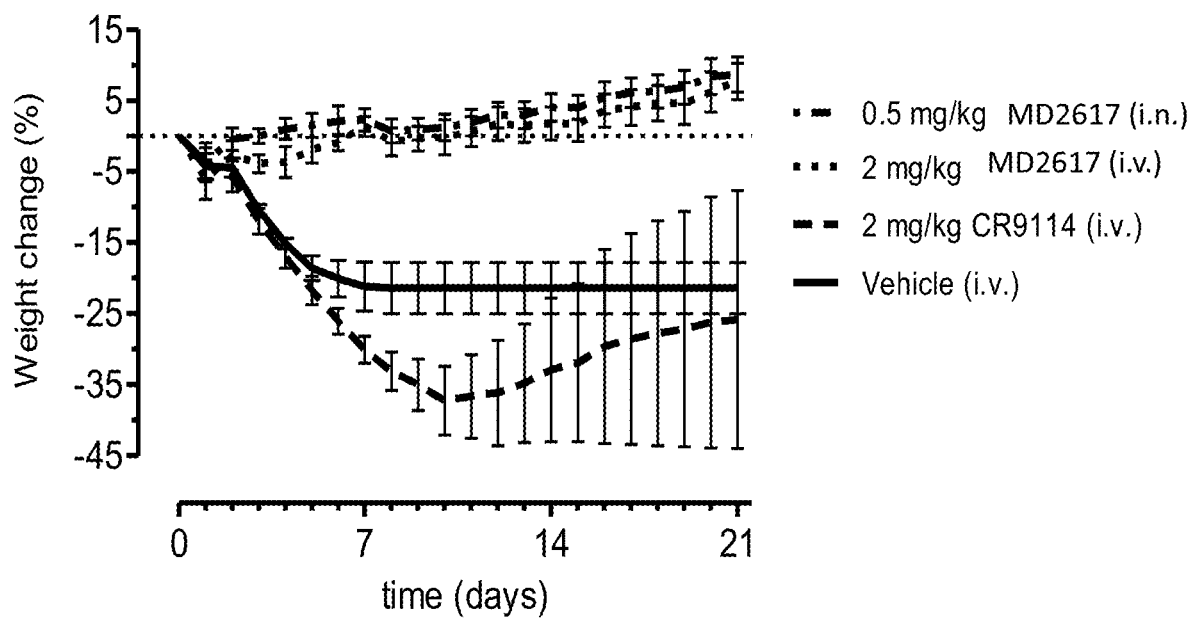
Figure 12B:
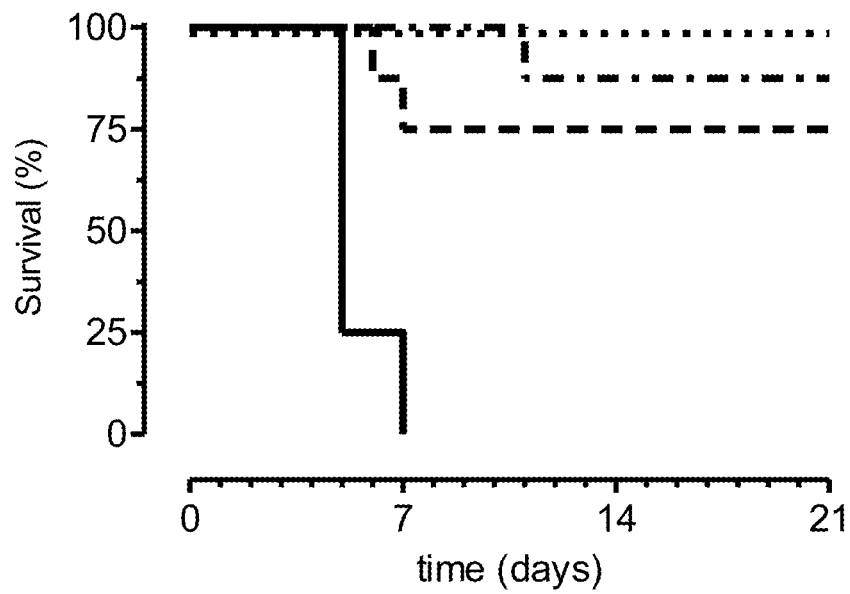
Figure 12B:
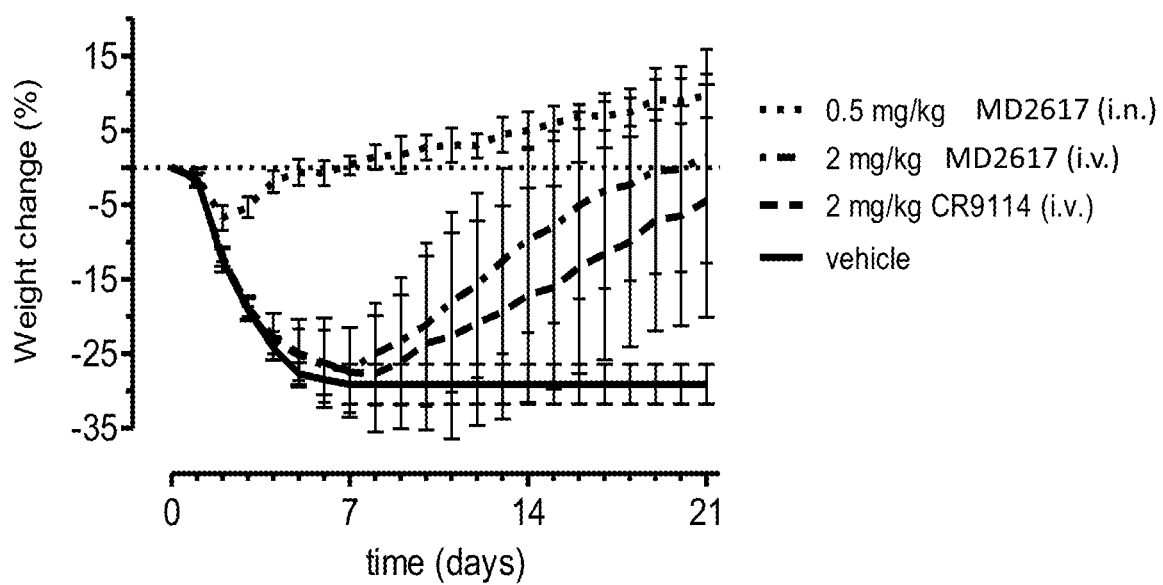

The exemplary multi-domain antibody MD2617 was selected for in vivo influenza neutralization studies using Balb/C mice. Briefly, 6-8 week old female Balb/C mice (n=8) were dosed with MD2617 either intranasally at 0.2 mg/kg, 0.05 mg/kg or 0.01 mg/kg or intravenously at 3, 1 or 0.3 mg/kg. Another group of 8 mice receiving buffer solution only served as a vehicle control group. One day post-administration mice were challenged intranasally with 25×LD50 of A/Puerto Rico/8/1934-MA (H1N1). Survival and body weight were monitored for 21 days after infection. Administration of MD2617 at a dose 0.2 mg/kg i.n. or 3 mg/kg i.v. resulted in a statistically significant improvement in survival proportion compared to the vehicle control group (FIGS. 11A-11B).

In Vivo Efficacy of Influenza A & B Multi-Domain Antibody MD2617 Against H3N2 and B Florida The exemplary multi-domain antibody MD2617 was selected for in vivo influenza neutralization studies using Balb/C mice. Briefly, 6-8 week old female Balb/C mice (n=8) were dosed with MD2617 either intranasally at 0.5 mg/kg or intravenously at 2 mg/kg. CR9114 dosed intravenously at 2 mg/kg was taken along as positive control. Another group of 8 mice receiving buffer solution only served as a vehicle control group. One day post-administration mice were challenged intranasally with 25×LD50 of A/Hong Kong/1/1968-MA (H3N2) or B/Florida/4/2006. Survival and body weight were monitored for 21 days after infection. Intranasal as well as intravenous administration of MD2617 resulted in a statistically significant improvement in survival proportion compared to the vehicle control group.

Figure 13A:
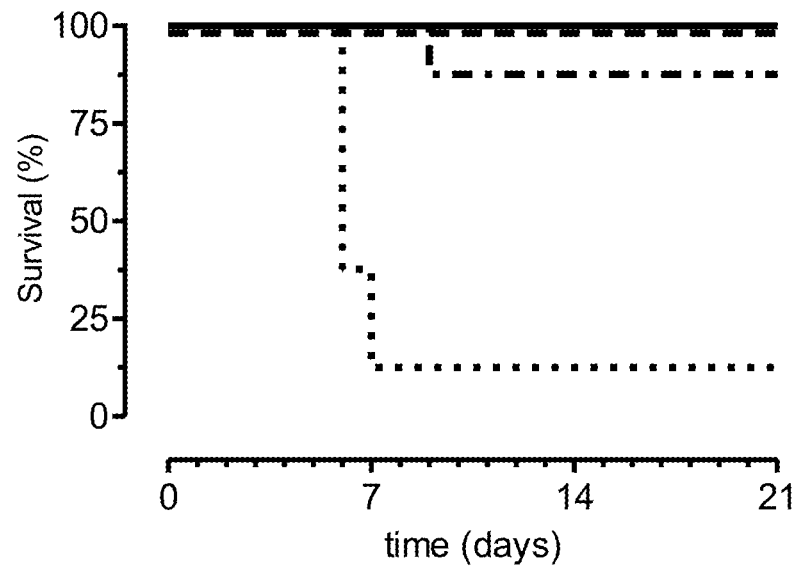
FIGS. 13A-13C show the in vivo efficacy of MD2407, MD3606 and CR9114 against a lethal challenge with B/Florida/4/2006 virus. Survival curves (top) and weight loss (bottom) of mice treated with 0.02, 0.1 or 0.5 mg/kg (multi-domain) antibody one day before challenge (at day 0) are shown.
Figure 13A:
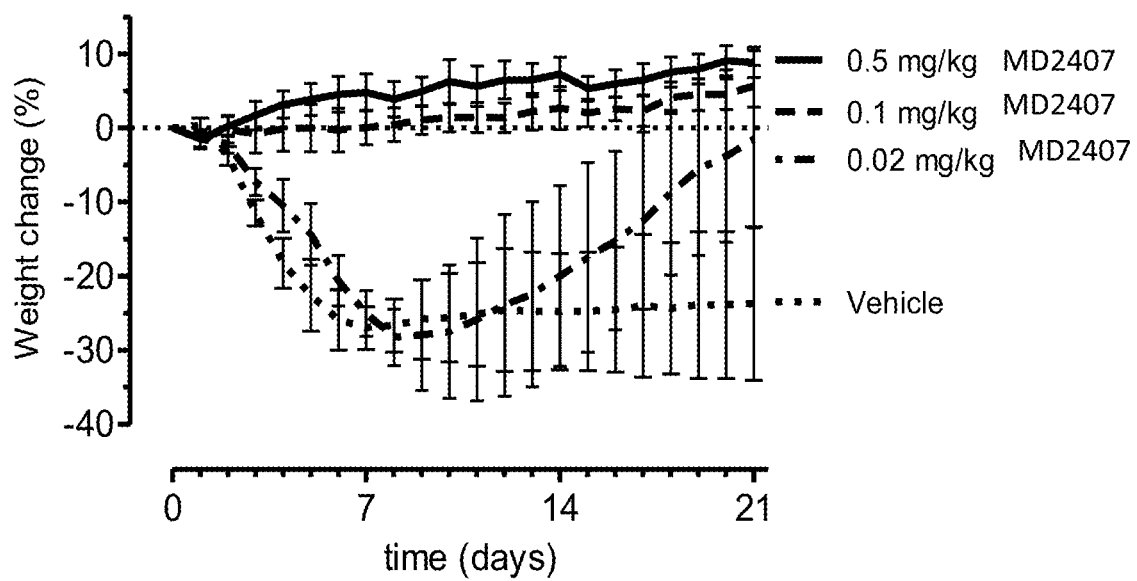
Figure 13B:
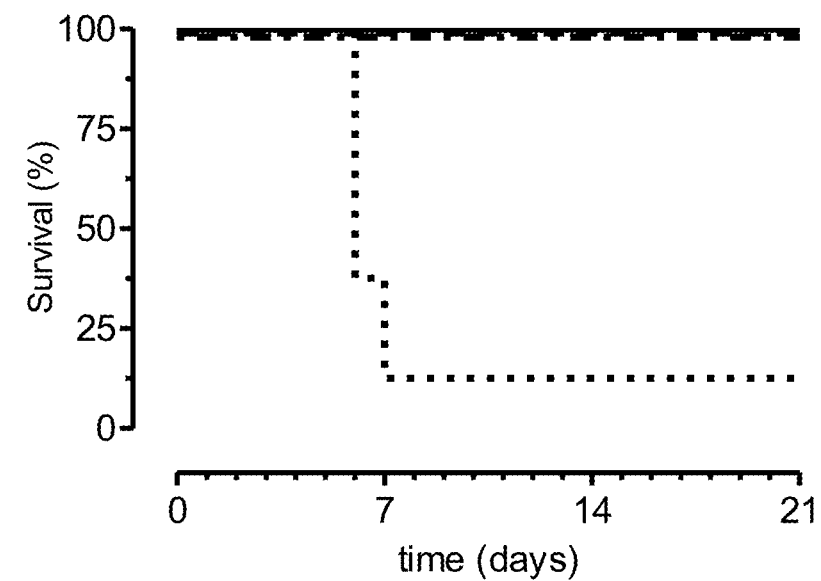
Figure 13B:
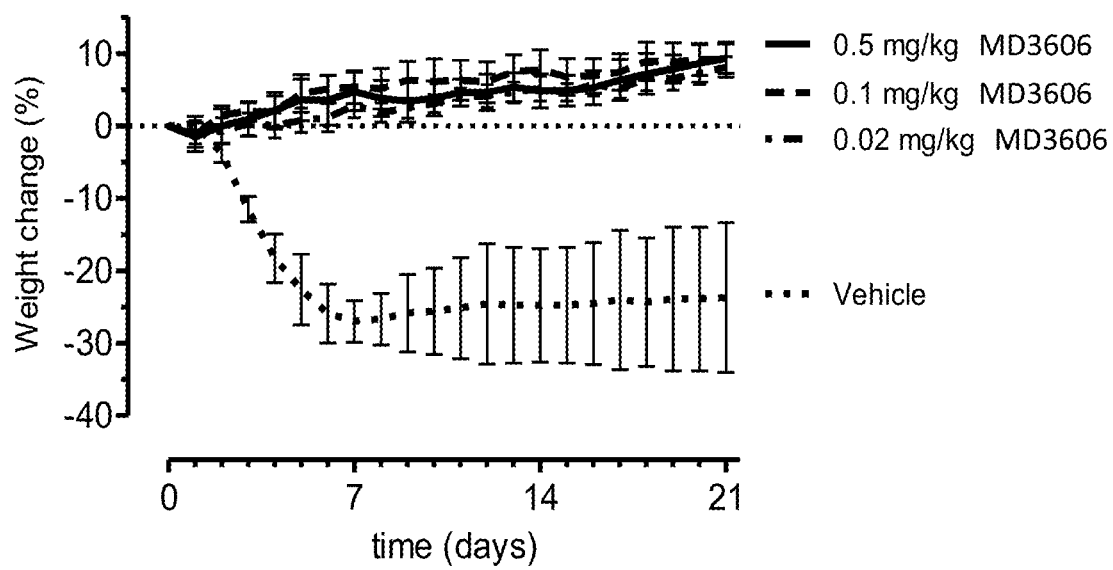
Figure 13C:
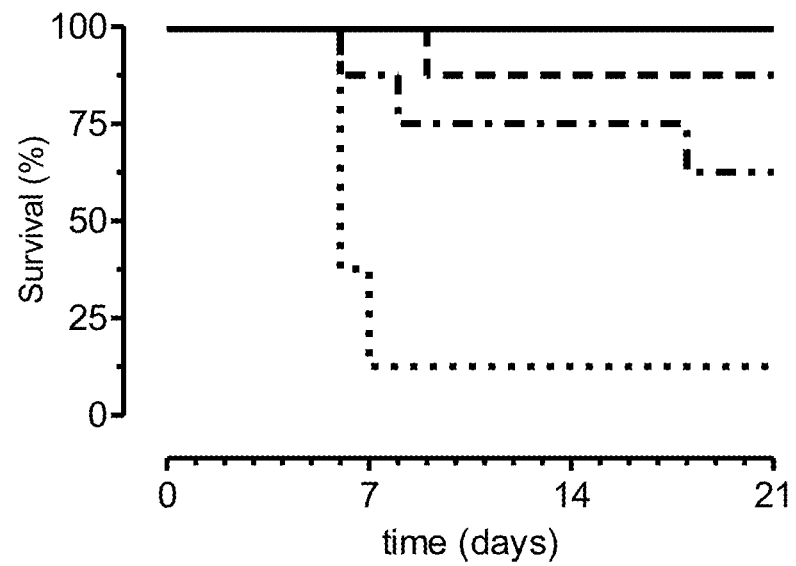
Figure 13C:
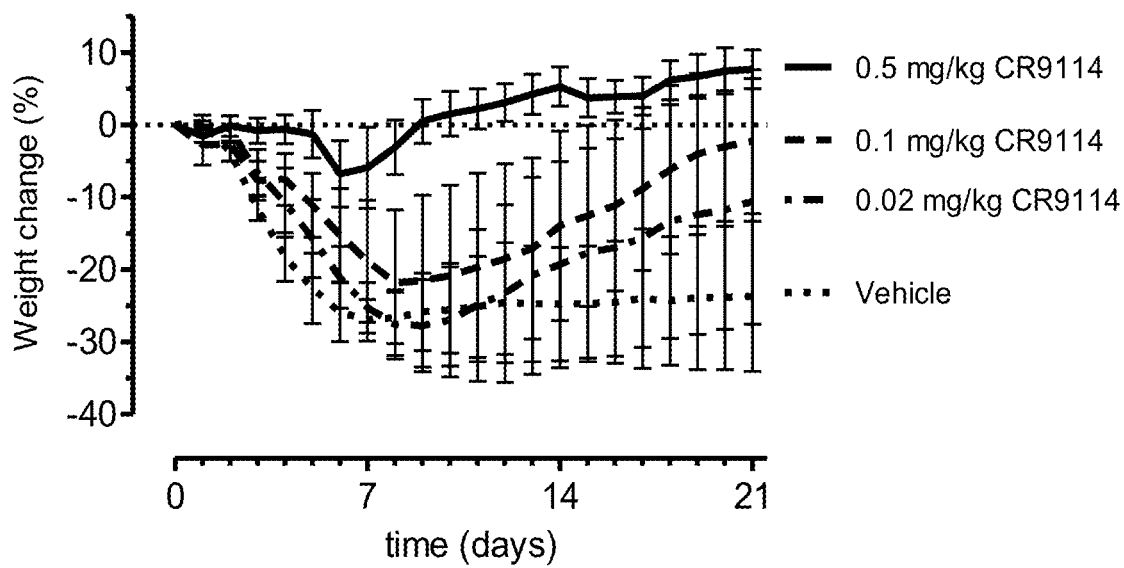

In Vivo Efficacy of Influenza A & B Multi-Domain Antibodies MD2407 and MD3606 Against B Florida after i.n. Administration The exemplary multi-domain antibodies MD2407 and MD3606 and reference antibody CR9114 were selected for in vivo influenza neutralization studies using Balb/C mice. Briefly, 6-8 week old female Balb/C mice (n=8) were dosed intranasally with MD2407, MD3606 or CR9114 at 3 doses (0.02 mg/kg, 0.1 mg/kg or 0.5 mg/kg). Another group of 8 mice receiving buffer solution only served as a vehicle control group. One day post-administration mice were challenged intranasally with 25×LD50 of influenza strain B/Florida/4/2006. Survival and body weight were monitored for 21 days after infection. Administration of 0.02, 0.1 and 0.5 mg/kg MD2407 and MD3606 resulted in a statistically significant improvement in survival proportion compared to the vehicle control group whereas administration of CR9114 only resulted in an improvement in survival proportion at 0.1 and 0.5 mg/kg (FIGS. 13A-13C).

Figure 14A:
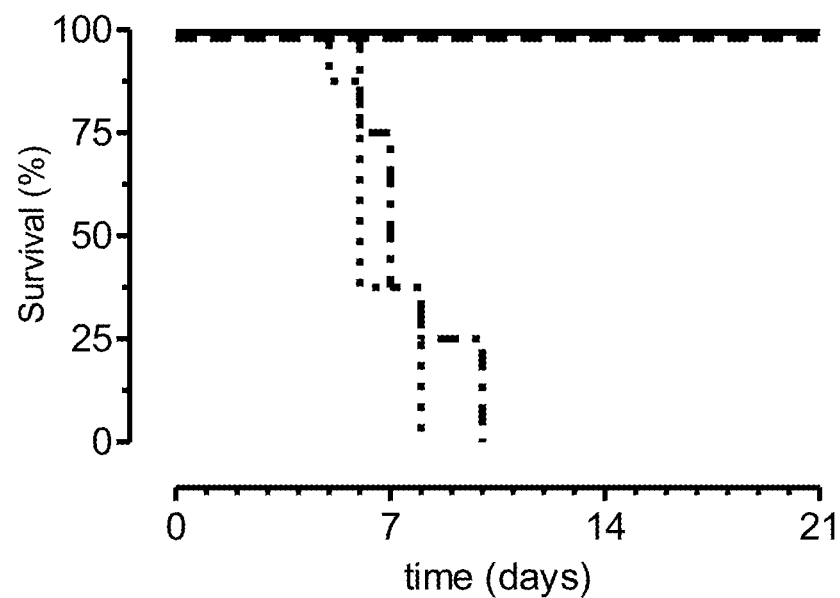
FIGS. 14A-14B show the in vivo efficacy of MD3606 and CR9114 against a lethal challenge with B/Florida/4/2006 virus. Survival curves (top) and weight loss (bottom) of mice treated with 0.2, 1 or 5 mg/kg (multi-domain) antibody one day before challenge (at day 0) are shown.
Figure 14A:
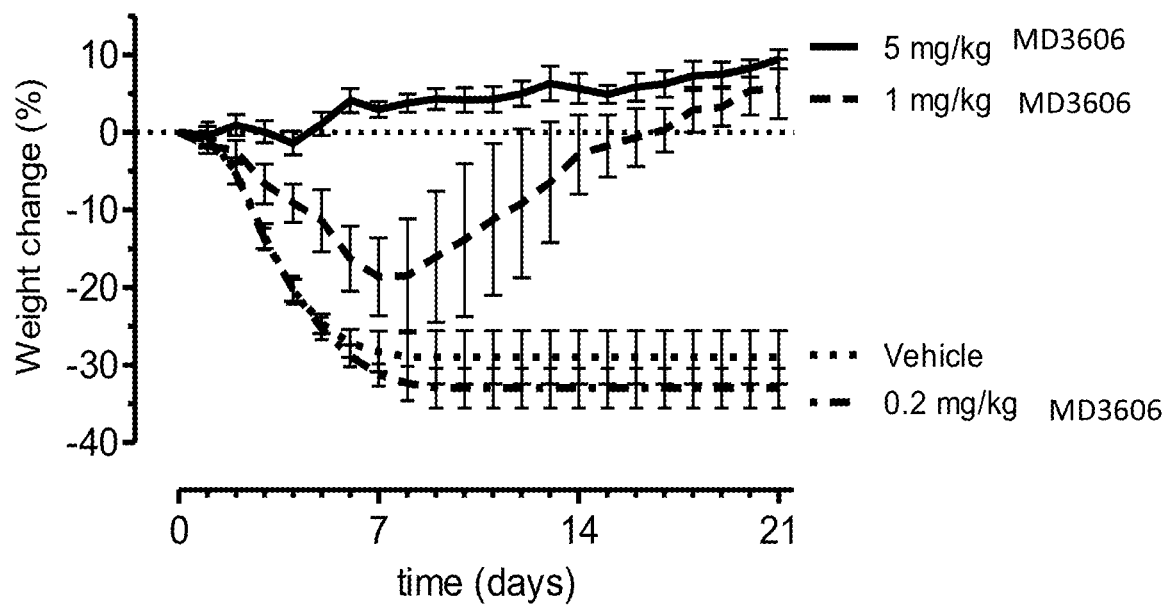
Figure 14B:
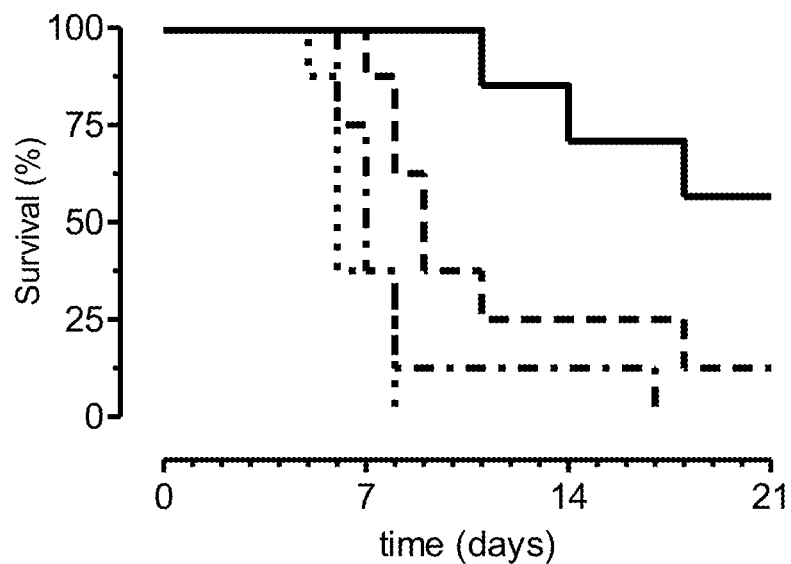
Figure 14B:
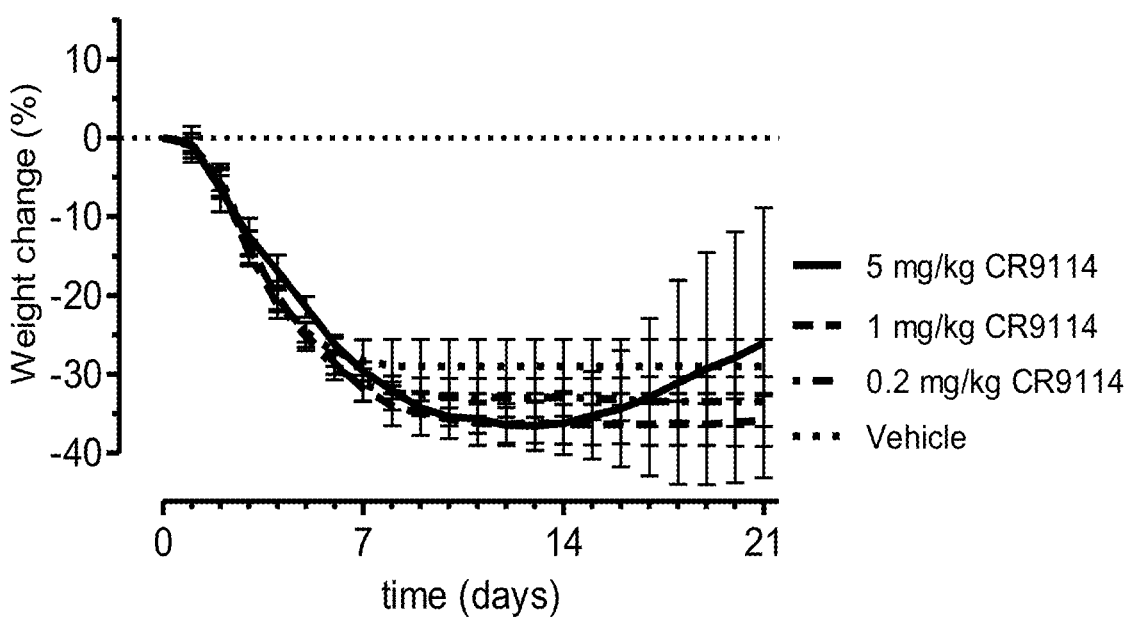

In Vivo Efficacy of Influenza A & B Multi-Domain Antibody MD3606 Against B Florida after i.v. Administration The exemplary multi-domain antibody MD3606 and reference antibody CR9114 were selected for in vivo influenza neutralization studies using Balb/C mice. Briefly, 6-8 week old female Balb/C mice (n=8) were dosed intravenously with MD3606 or CR9114 at 3 doses (0.2 mg/kg, 1 mg/kg or 5 mg/kg). Another group of 8 mice receiving buffer solution only served as a vehicle control group. One day post-administration mice were challenged intranasally with 25×LD50 of influenza strain B/Florida/4/2006. Survival and body weight were monitored for 21 days after infection. This study shows that MD3606 provides full protection against B/Florida/4/2006 down to a dose of 1 mg/kg. In contrast reference antibody CR9114 only provides partial protection at the highest dose of 5 mg/kg (FIGS. 14A-14B).

Figure 15A:
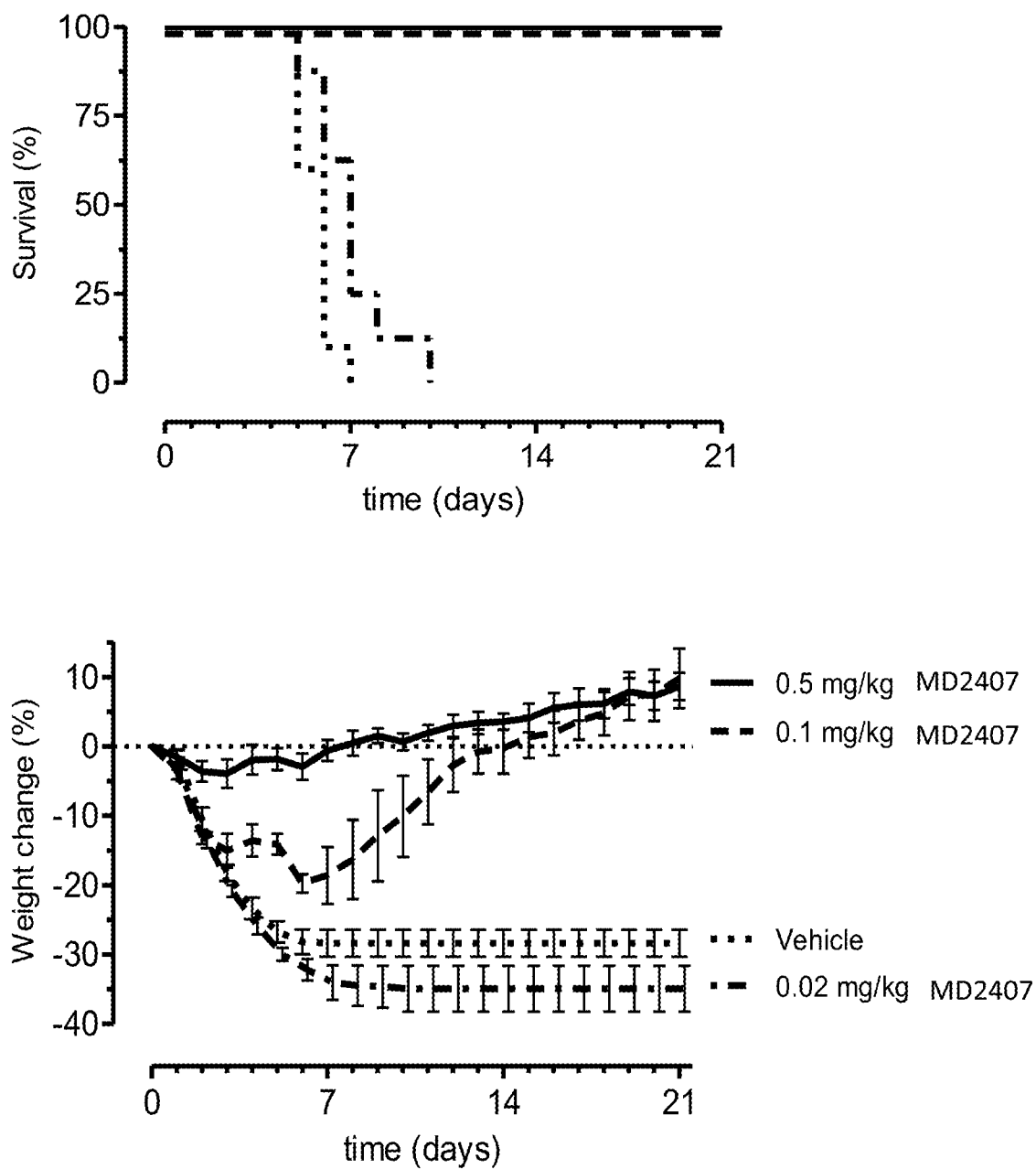
FIGS. 15A-15C show the in vivo efficacy of MD2407, MD3606 and CR9114 against a lethal challenge with B/Florida/4/2006 virus. Survival curves (top) and weight loss (bottom) of mice treated with 0.02, 0.1 or 0.5 mg/kg (multi-domain) antibody one day before challenge (at day 0) are shown.
Figure 15B:
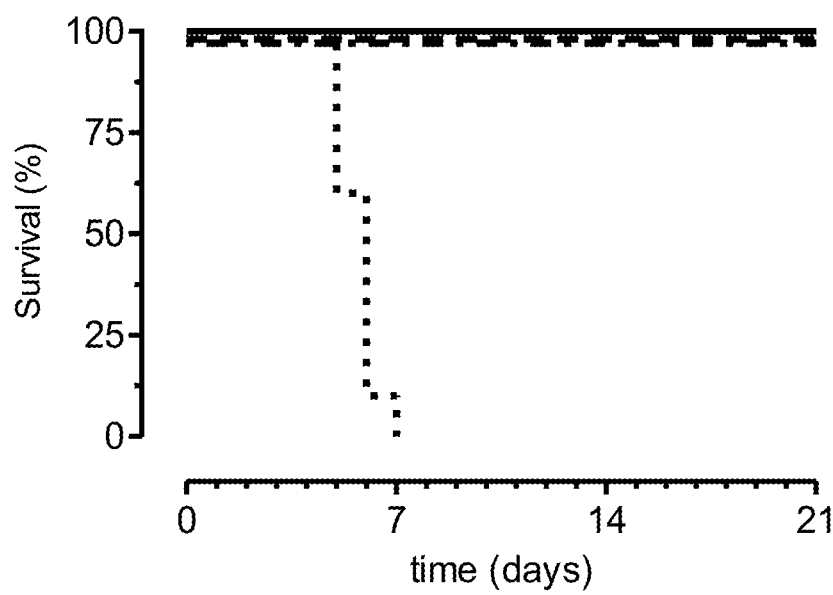
Figure 15B:
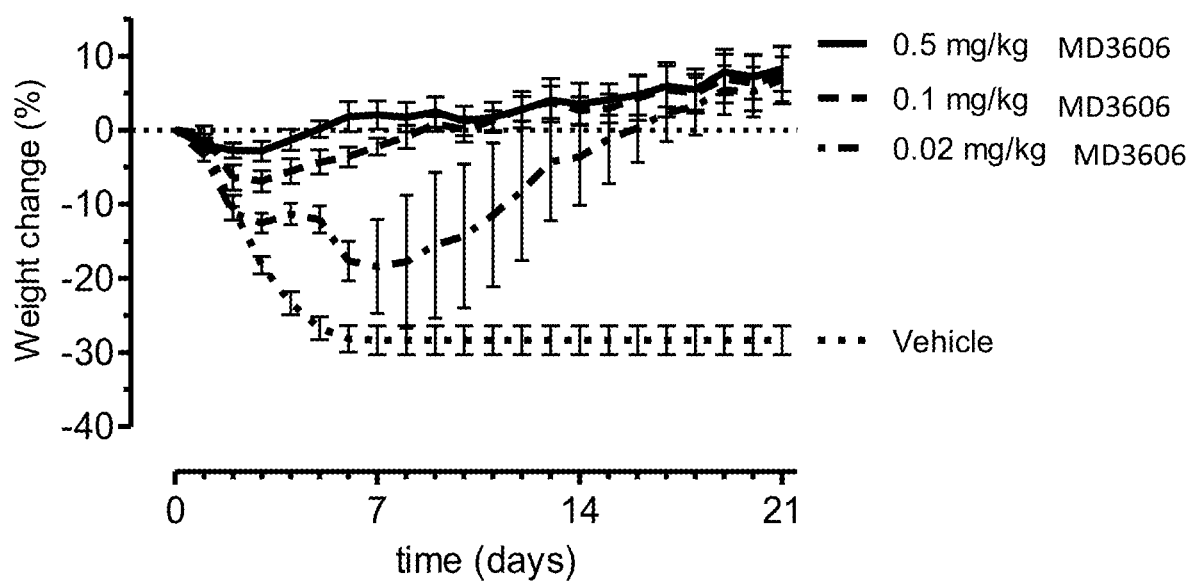
Figure 15C:
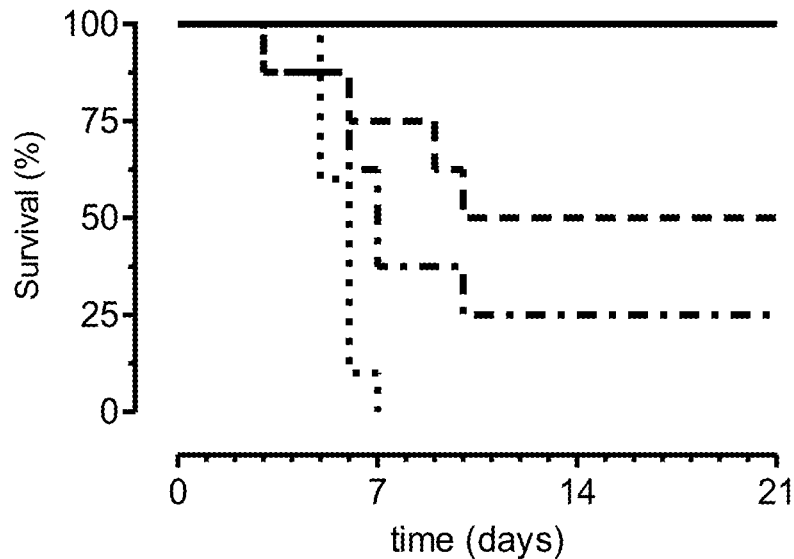
Figure 15C:
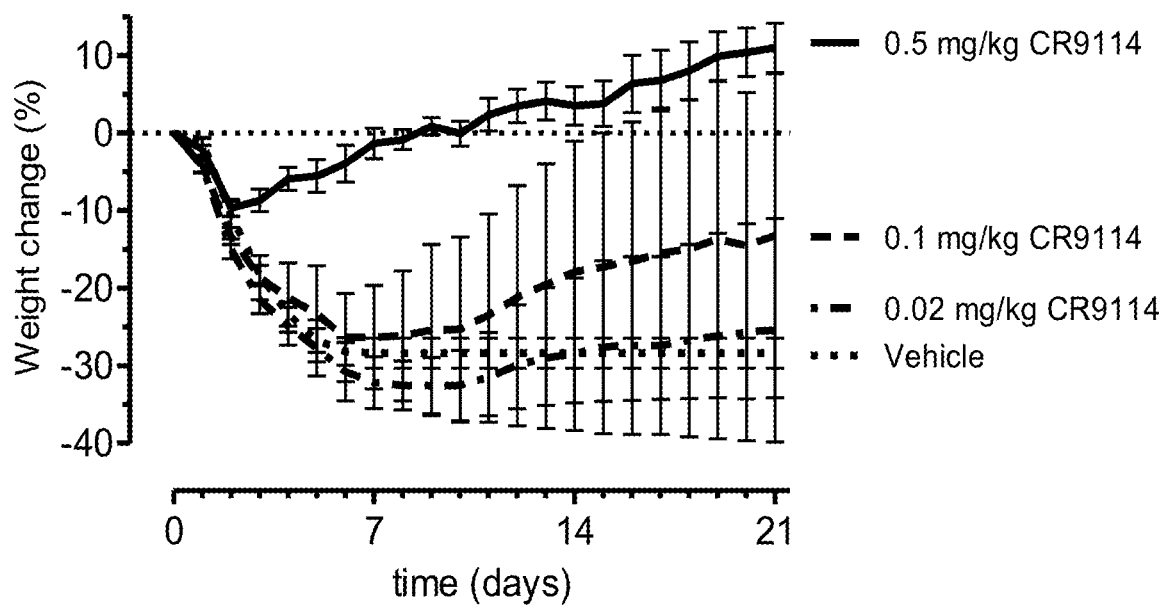

In Vivo Efficacy of Influenza A & B Multi-Domain Antibodies MD2407 and MD3606 Against H3N2 after i.n. Administration The exemplary multi-domain antibodies MD2407, MD3606 and reference antibody CR9114 were selected for in vivo influenza neutralization studies using Balb/C mice. Briefly, 6-8 week old female Balb/C mice (n=8) were dosed intranasally with MD2407, MD3606 and CR9114 at 3 doses (0.02 mg/kg, 0.1 mg/kg or 0.5 mg/kg). Another group of 8 mice receiving buffer solution only served as a vehicle control group. One day post-administration mice were challenged intranasally with 25×LD50 of influenza strain A/Hong Kong/1/1968-MA (H3N2). Survival and body weight were monitored for 21 days after infection. This study shows that MD2407 and CR9114 provide full protection against A/Hong Kong/1/1968-MA down to a dose of, respectively, 0.1 and 0.5 mg/kg. MD3606 provides full protection even at the lowest dose of 0.02 mg/kg (FIGS. 15A-15C).

Figure 16A:
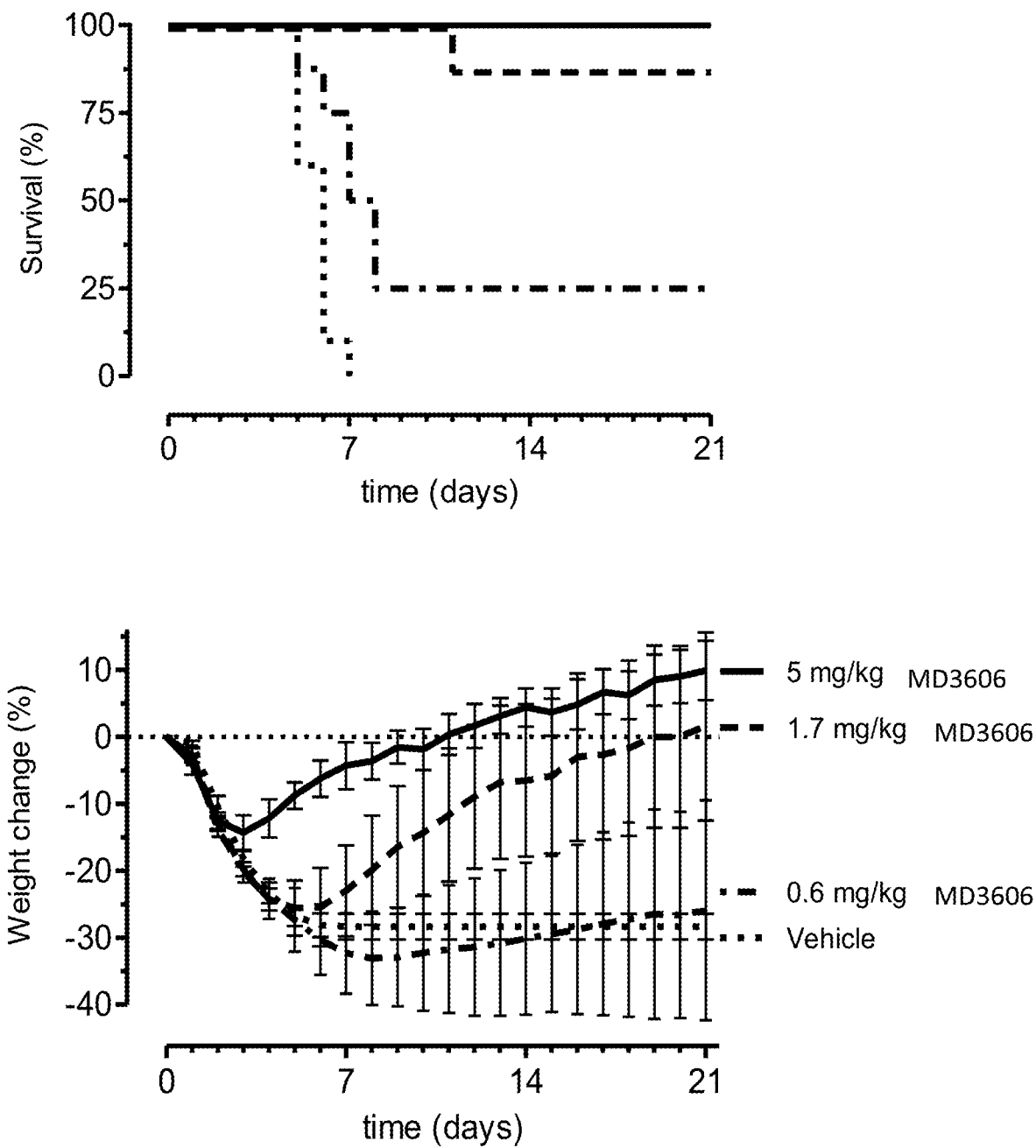
FIGS. 16A-16B show the in vivo efficacy of MD3606 and CR9114 against a lethal challenge with A/Hong Kong/1/1968-MA (H3N2) virus. Survival curves (top) and weight loss (bottom) of mice treated with 0.6, 1.7 or 5 mg/kg (multi-domain) antibody one day before challenge (at day 0) are shown.
Figure 16B:
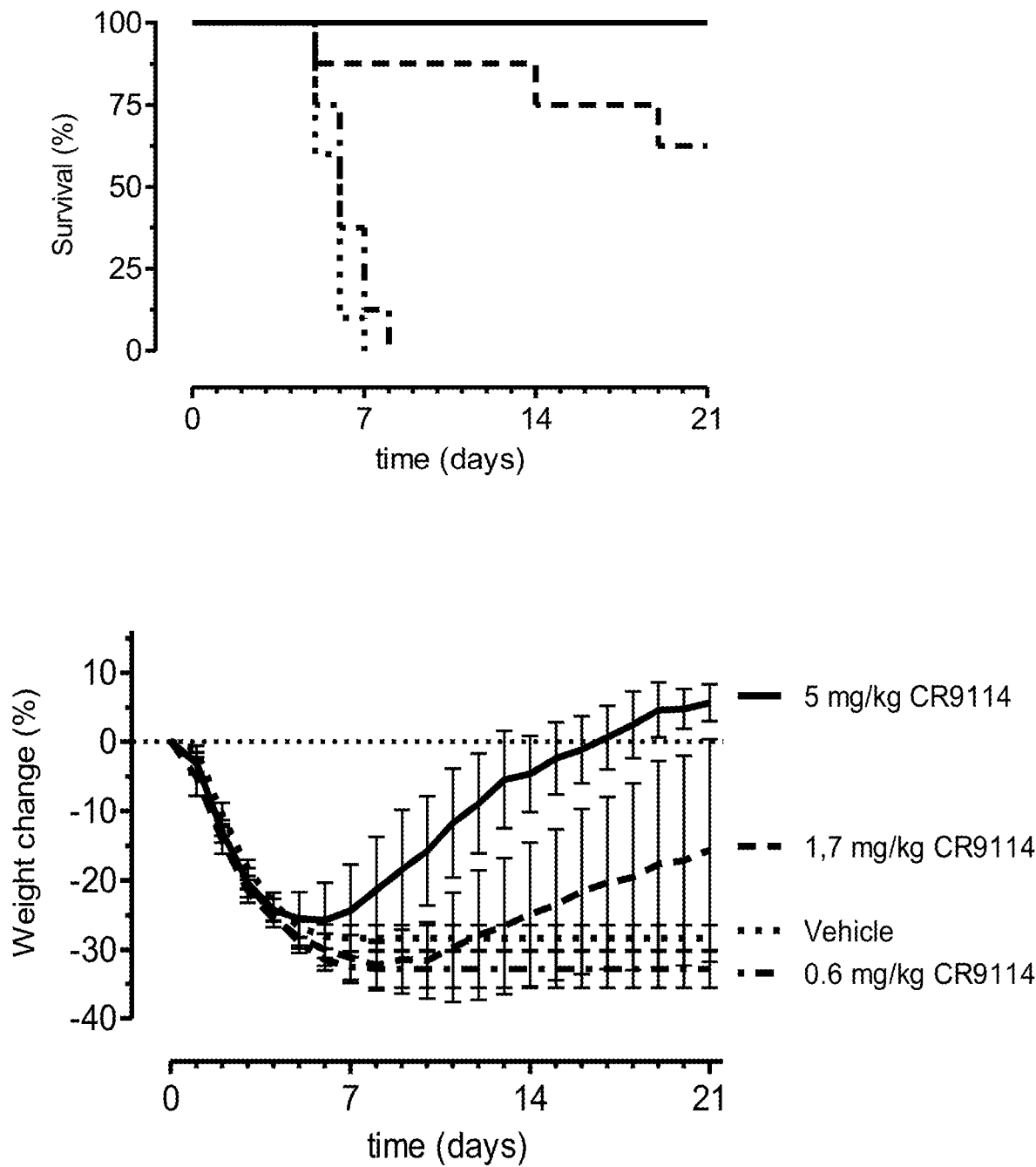

In Vivo Efficacy of Influenza A & B Multi-Domain Antibody MD3606 Against H3N2 after i.v. Administration The exemplary multi-domain antibody MD3606 and reference antibody CR9114 were selected for in vivo influenza neutralization studies using Balb/C mice. Briefly, 6-8 week old female Balb/C mice (n=8) were dosed intravenously with MD3606 or CR9114 at 3 doses (0.6 mg/kg, 1.7 mg/kg or 5 mg/kg). Another group of 8 mice receiving buffer solution only served as a vehicle control group. One day post-administration mice were challenged intranasally with 25×LD50 of influenza strain A/Hong Kong/1/1968-MA (H3N2). Survival and body weight were monitored for 21 days after infection. Administration of MD3606 and CR9114 down to a dose 1.7 mg/kg resulted in a statistically significant improvement in survival proportion compared to the vehicle control group. Mice treated with 5 or 1.7 mg/kg MD3606 showed a smaller drop in body weight than mice treated with the same doses of CR9114 (FIGS. 16A-16B).

Figure 17A:
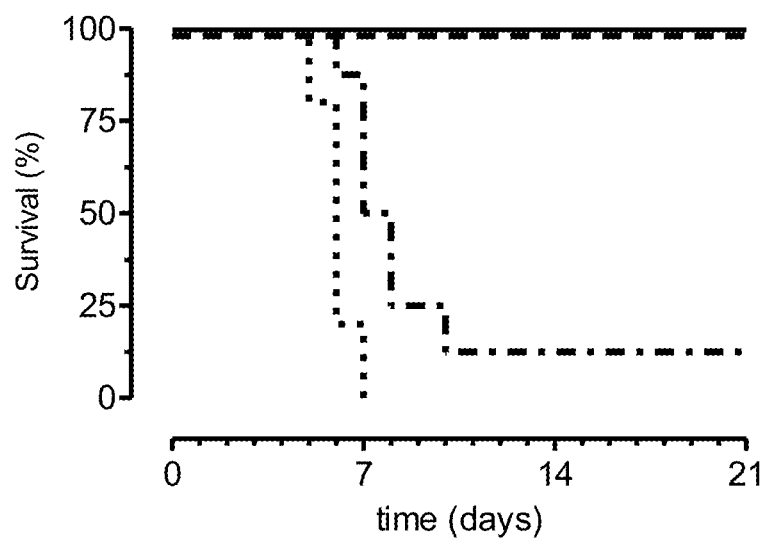
FIGS. 17A-17C show the in vivo efficacy of MD2407, MD3606 and CR9114 against a lethal challenge with A/Puerto Rico/8/1934-MA (H1N1) virus. Survival curves (top) and weight loss (bottom) of mice treated with 0.01, 0.05 or 0.25 mg/kg (multi-domain) antibody one day before challenge (at day 0) are shown.
Figure 17A:
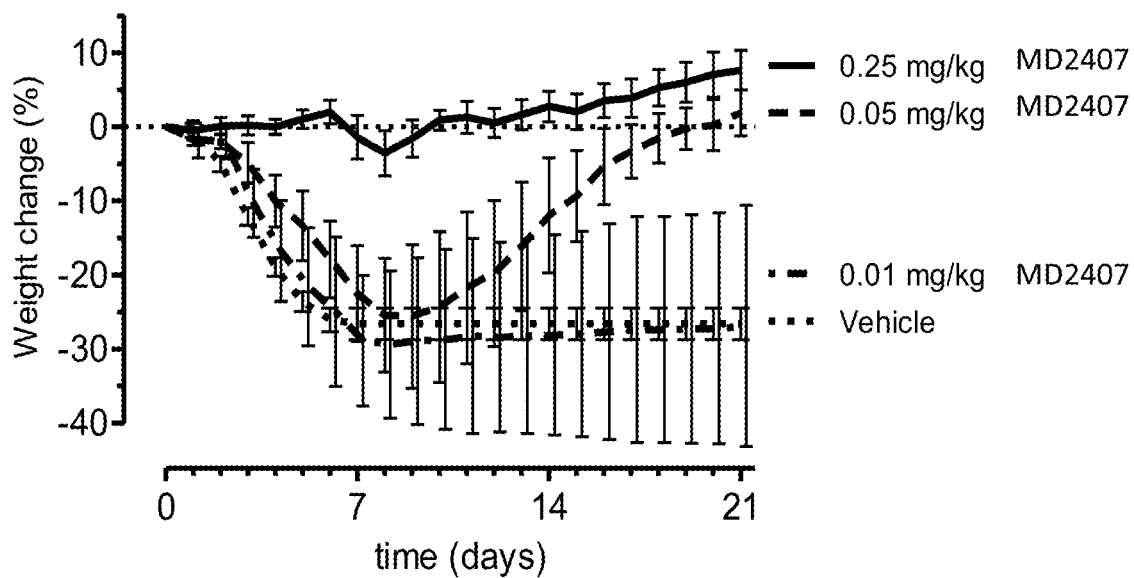
Figure 17B:
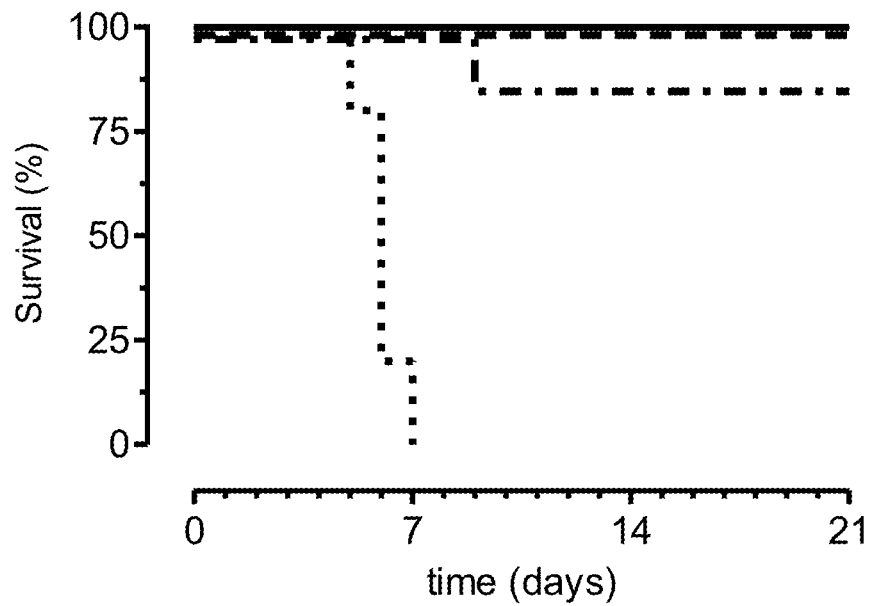
Figure 17B:
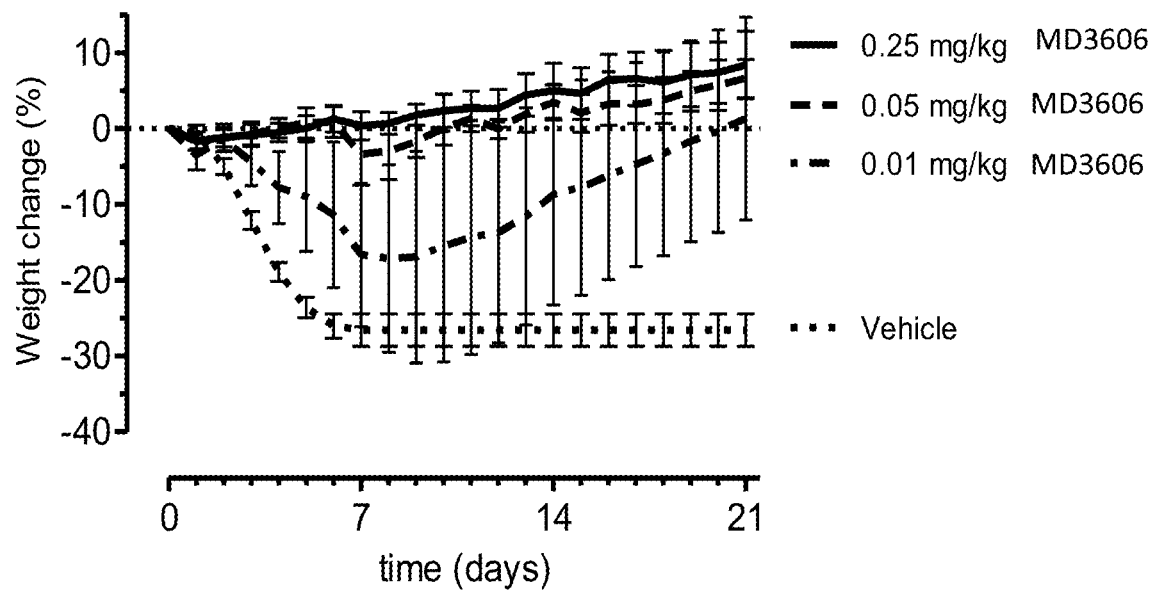
Figure 17C:
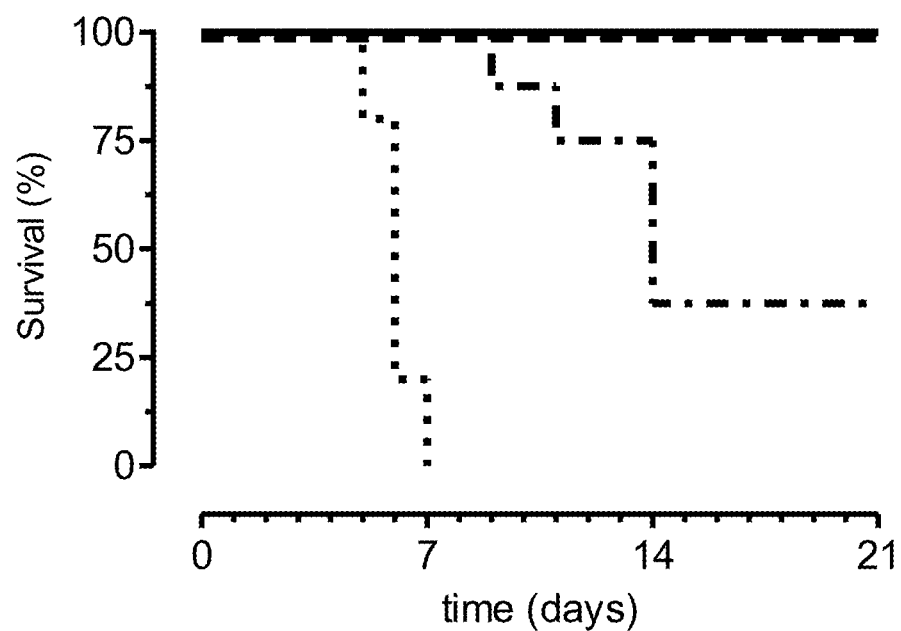
Figure 17C:
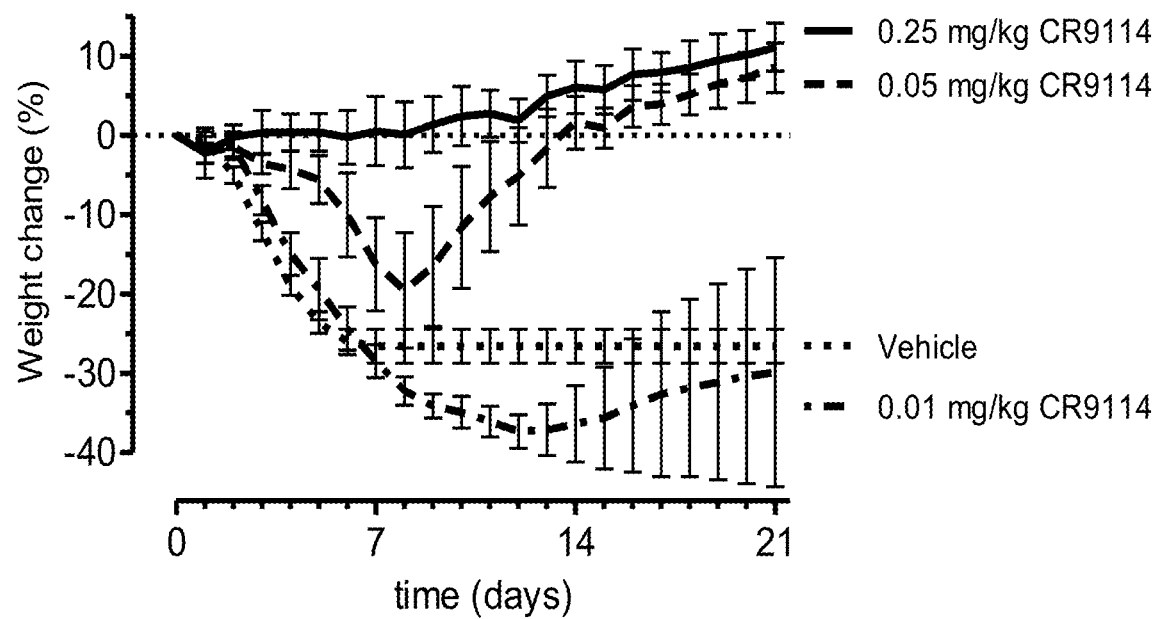

In Vivo Efficacy of Influenza A & B Multi-Domain Antibodies MD2407 and MD3606 Against H1N1 after i.n. Administration The exemplary multi-antibodies MD2407, MD3606 and reference antibody CR9114 were selected for in vivo influenza neutralization studies using Balb/C mice. Briefly, 6-8 week old female Balb/C mice (n=8) were dosed intranasally with MD2407, MD3606 or CR9114 at 3 doses (0.02 mg/kg, 0.1 mg/kg or 0.5 mg/kg). Another group of 8 mice receiving buffer solution only served as a vehicle control group. One day post-administration mice were challenged intranasally with 25×LD50 of influenza strain A/Puerto Rico/8/1934-MA (H1N1). Survival and body weight were monitored for 21 days after infection. Administration of 0.25 and 0.05 mg/kg MD2407 or CR9114 resulted in a statistically significant improvement in survival proportion compared to the vehicle control group, while for MD3606 this improvement was significant down to the lowest dose of 0.01 mg/kg (FIGS. 17A-17C).

Figure 18A:
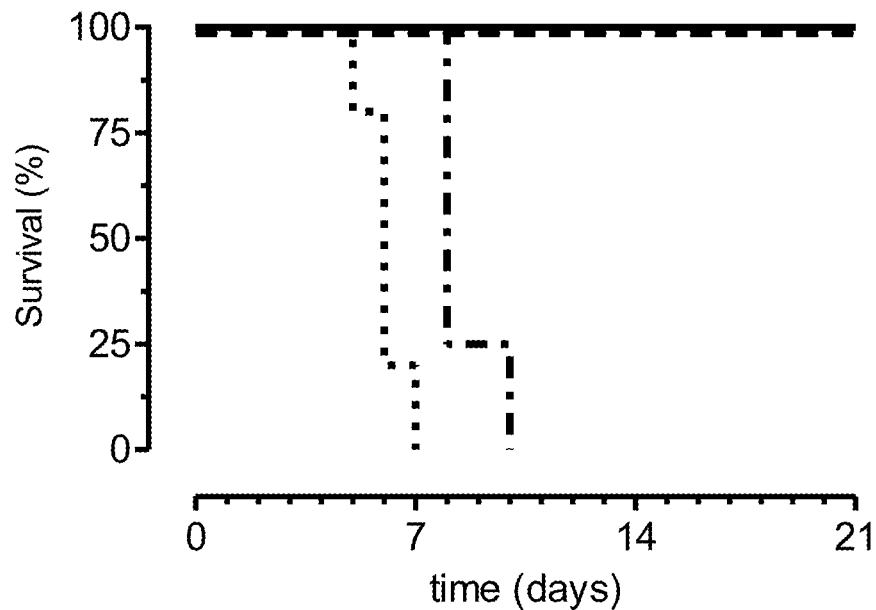
FIGS. 18A-18B show the in vivo efficacy of MD3606 and CR9114 against a lethal challenge with A/Puerto Rico/8/1934-MA (H1N1) virus. Survival curves (top) and weight loss (bottom) of mice treated with 0.6, 1.7 or 5 mg/kg (single domain) antibody one day before challenge (at day 0) are shown.
Figure 18A:
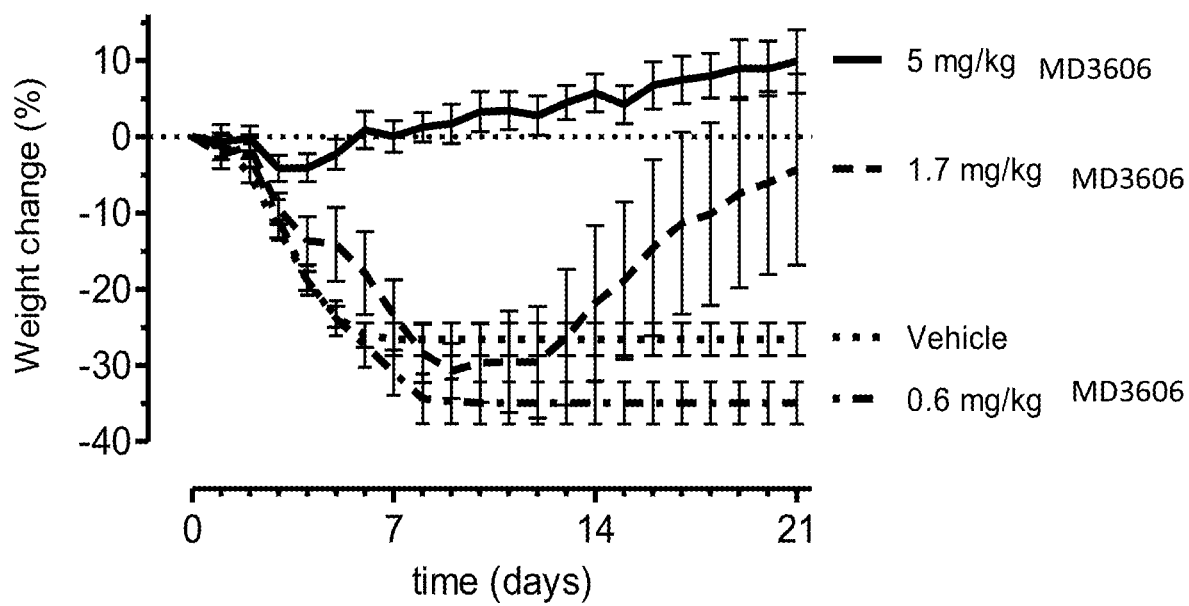
Figure 18B:
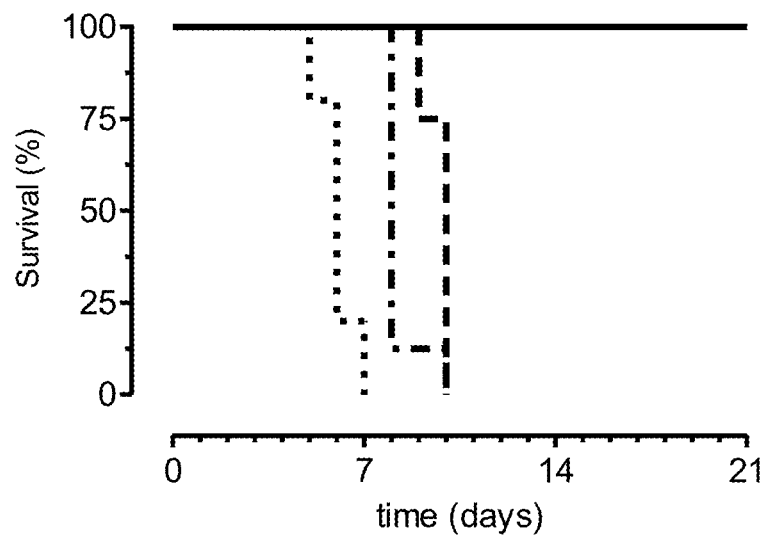
Figure 18B:
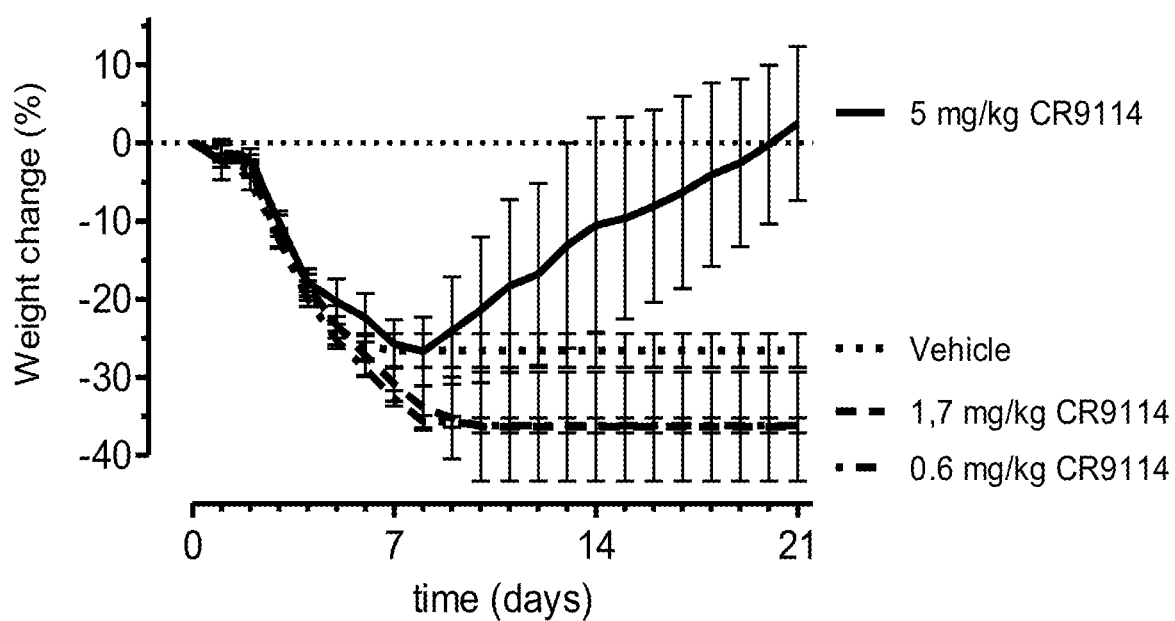

In Vivo Efficacy of Influenza A & B Multi-Domain Antibody MD3606 Against H1N1 after i.v. Administration The exemplary multi-domain antibody MD3606 and reference antibody CR9114 were selected for in vivo influenza neutralization studies using Balb/C mice. Briefly, 6-8 week old female Balb/C mice (n=8) were dosed intravenously with MD3606 or CR9114 at 3 doses (0.6 mg/kg, 1.7 mg/kg or 5 mg/kg). Another group of 8 mice receiving buffer solution only served as a vehicle control group. One day post-administration mice were challenged intranasally with 25×LD50 of influenza strain A/Puerto Rico/8/1934-MA (H1N1). Survival and body weight were monitored for 21 days after infection. Administration of 1.7 and 5 mg/kg MD3606 and 5 mg/kg CR9114 resulted in a statistically significant improvement in survival proportion compared to the vehicle control group (FIGS. 18A-18B).

Example 11: sdAb Humanization

Protein sequences of sdAbs SD1036, SD1038, SD1046, SD1083, SD1084 and SD1087 were blasted against the IMGT human G genes database (website: www_imgt_org). Each sdAb was subsequently aligned with the most homologous human V gene sequence. The FR4 sequence of each sdAb was aligned with the human J consensus sequence WGQGTLVTVSS. Amino acid differences in the sdAb framework regions (FRs) relative to the aligned human V and J sequences are indicated in table 39.

Subsequently multiple series of sdAb variants were made in which different combinations of non-human FR residues were replaced by their human equivalents. Residues 37, 44, 45 and 47 in FR2 and 103 in FR4 were retained in all variants. Two Met residues, one located in CDR2 of SD1087 and the other in CDR3 of SD1038 were also mutated with the aim to remove a potential Met oxidation site. Amino acid sequences of all variants of sdAbs SD1036, SD1038, SD1046, SD1083, SD1084 and SD1087 are listed in table 40. Humanized sdAb variants were analyzed for temperature stability, expression level (in HEK293 cells) and in vitro neutralizing activity. Temperature stability was assessed for selected sdAbs by measuring their melting temperatures using DSC. In vitro neutralizing activity was determined in a standard 3-day VNA using MDCK cells and ~100 $TCID_{50}$ of influenza virus. $IC_{50}$ values, melting temperatures and expression levels are listed in Tables 41-43. The number of amino acid differences in the sdAb framework regions (FRs) relative to the aligned human V and J sequences as well as the calculated % FR identity are also listed.

TABLE 39

Amino acid differences in framework regions relative to the closest human V gene sequence and consensus J sequence

|  | FR1 | CDR1 | FR2 | CDR2 |
|---|---|---|---|---|
| SD1083 | EVQLVESGGGLVQPGGSLRLSCAATG (341) | FTLENKAIG (353) | WFRQTPGSEREGVL (365) | CISKSGSW (377) |
| 3-23*01 | EVQLLESGGGLVQPGGSLRLSCAASG (342) | FTFSSYAMS (354) | WVRQAPGKGLEWVS (366) | AISGSGGS (378) |
|  | ....V..................T. |  | .F..T..SER.G.L |  |
| SD1038 | EVQLVESGGGLVQPGGSLRLSCAVSI (343) | SIFDIYAMD (355) | WYRQPAGKQRDLVA (367) | TSF-RDGS (379) |
| NL1*01 | QVQLVESGGGVVQPGGSLRLSCAASG (344) | FTFSSYGMH (356) | WVRQAPGKGLEWVS (368) | VIYSGGSS (380) |
|  | E........L...........V.I |  | .Y......QRDL.A |  |
| SD1036 | EVQLVESGGGLVQAGGSLKLSCAASG (345) | RT---YAMG (357) | WFRQAPGKEREFVA (369) | HINALGTR (381) |
| 3-23*01 | EVQLLESGGGLVQPGGSLRLSCAASG (346) | FTFSSYAMS (358) | WVRQAPGKGLEWVS (370) | AISGSGGS (382) |
|  | ....V........A....K....... |  | .F......ER.F.A |  |
| SD1046 | EVQLVESGGGLVQAGDSLRISCAASG (347) | RTLSIYSMG (359) | WFRQAPGKEREFVA (371) | TIGWNSGR (383) |
| 3-23*04 | EVQLVESGGGLVQPGGSLRLSCAASG (348) | FTFSSYAMS (360) | WVRQAPGKGLEWVS (372) | AISGSGGS (384) |
|  | .............A.D...I...... |  | .F......ER.F.A |  |
| SD1084 | EVQLVESGGGLVQPGGSLKLSCAASG (349) | FTFSTSWMY (361) | WLRQAPGKGLEWVS (373) | VINTDGG (385) |
| 3-66*01 | EVQLVESGGGLVQPGGSLRLSCAASG (350) | FTVSSNYMS (362) | WVRQAPGKGLEWVS (374) | VIYSGGS (386) |
|  | ..................K....... |  | .L............ |  |
| SD1087 | EVQLVESGGGLVQPGGSLRLSCVISG (351) | LSLDTYAVG (363) | WFRQAPGKEREGIT (375) | CISSGHGM (387) |
| 3-23*04 | EVQLVESGGGLVQPGGSLRLSCAASG (352) | FTFSSYAMS (364) | WVRQAPGKGLEWVS (376) | AISGSGGS (388) |
|  | ......................VI.. |  | .F......ER.GIT |  |

|  | FR3 | CDR3 | FR4 |
|---|---|---|---|
| SD1083 | TYYTDSMRGRFTISRDNAENTVYLQMDSLKPEDTAVYYC (389) | ATTTAGGGLCWDGTTFSRLASS (401) | WGQGTQVTVSS (407) |
| 3-23*01 | TYYADSVKGRFTISRDNSKNTLYLQMNSLRAEDTAVYYC (390) | ---------------------- | WGQGTLVTVSS (408) |
|  | ...T..MR.........AE..V....D..KP........ |  | .....Q..... |
| SD1038 | TNYADSVKGRFTISRDNAKNTLYLQMNSLKPEDTAVYLC (391) | HVSLYRDPLGVAGGMGVY (402) | WGKGALVTVSS (409) |
| NL1*01 | TYYADSVKGRFTISRDNSKNTLYLQMNSLRAEDTAVYYC (392) | ------------------ | WGQGTLVTVSS (410) |
|  | .N................A..........KP......L. |  | ..K.A...... |
| SD1036 | TYYSDSVKGRFTISRDNAKNTEYLEMNNLKPEDTAVYYC (393) | TAQGQWRAAPVAVAAEYEF (403) | WGQGTQVTVSS (411) |
| 3-23*01 | TYYADSVKGRFTISRDNSKNTLYLQMNSLRAEDTAVYYC (394) | ------------------- | WGQGTLVTVSS (412) |
|  | ...S.............A...E..E..N.KP........ |  | .....Q..... |
| SD1046 | TFYPDSLKGRFTISRDNARNTLYLQMNNLRPEDTAVYYC (395) | AAAKGPLRLSSQADY (404) | WGQGTQVTVSS (413) |
| 3-23*04 | TYYADSVKGRFTISRDNSKNTLYLQMNSLRAEDTAVYYC (396) | --------------- | WGQGTLVTVSS (414) |
|  | .F.P..L...........AR........N..P........ |  | .....Q..... |
| SD1084 | TYYADSVKDRFTISRDNAKDTLYLQMSSLKSEDTAVYYC (397) | AKDWGGPEPT (405) | RGQGTQVTVSS (415) |
| 3-66*01 | TYYADSVKGRFTISRDNSKNTLYLQMNSLRAEDTAVYYC (398) | ---------- | WGQGTLVTVSS (416) |
|  | ........D........A.D......S..KS........ |  | R....Q..... |
| SD1087 | TYYADSVKGRFTVSTDNAKNTVYLQMNGLQPEDTARYYC (399) | ATESRYYCSDNWPAPQRYIY (406) | WGQGTQVTVSS (417) |
| 3-23*04 | TYYADSVKGRFTISRDNSKNTLYLQMNSLRAEDTAVYYC (400) | -------------------- | WGQGTLVTVSS (418) |
|  | ............V.T..A...V.....G.QP....R... |  | .....Q..... |

TABLE 40

Sequences of humanized binding molecules of the invention

SD1036 humanized variants

SD3023
(SEQ ID NO: 146)
EVQLLESGGGLVQAGGSLRLSCAASGRTYAMSWFRQAPGKEREFVSHINALG
TRTYYADSVKGRFTISRDNSKNTLYLQMNSLRPEDTAVYYCTAQGQWRAAPV
AVAAEYEFWGQGTQVTVSS

SD3024
(SEQ ID NO: 147)
EVQLLESGGGLVQPGGSLRLSCAASGRTYAMSWERQAPGKEREFVSHINALG
TRTYYADSVKGRFTISRDNSKNTLYLQMNSLRAEDTAVYYCTAQGQWRAAPV
AVAAEYEFWGQGTQVTVSS

SD3025
(SEQ ID NO: 148)
EVQLLESGGGLVWPGGSLRLSCAASGRTYAMSWFRQAPGKEREEVANINALG
TRTYYADSVKGRFTISRDNSKNTLYLQMNSLRAEDTAVYYCTAQGQWRAAPV
AVAAEYEFWGQGTQVTVSS

SD3026
(SEQ ID NO: 149)
EVQLLESGGGLVWPGGSLRLSCAASGRTYAMSWFRQAPGKEREFVSAINALG
TRTYYADSVKGRFTISRDNSKNTLYLQMNSLRAEDTAVYYCTAQGQWRAAPV
AVAAEYEFWGQGTQVTVSS

SD3027
(SEQ ID NO: 150)
EVQLLESGGGLVQAGGSLRLSCAASGRTYAMSWFRQAPGKEREFVSAINALG
TRTYYADSVKGRFTISRDNSKNTLYLQMNSLRAEDTAVYYCTAQGQWRAAPV
AVAAEYEFWGQGTQVTVSS

SD3028
(SEQ ID NO: 151)
EVQLLESGGGLVQAGGSLRLSCAASGRTYAMSWFRQAPGKEREEVANINALG
TRTYYADSVKGRFTISRDNSKNTLYLQMNSLRPEDTAVYYCTAQGQWRAAPV
AVAAEYEFWGQGTQVTVSS

SD3094
(SEQ ID NO: 152)
EVQLLESGGGLVWPGGSLRLSCAASGRTYAMGWERQAPGKEREEVANINALG
TRTYYADSVKGRFTISRDNSKNTLYLQMNSLRAEDTAVYYCTAQGQWRAAPV
AVAAEYEFWGWGTLVTVSS

SD3095
(SEQ ID NO: 153)
EVQLLESGGGLVWPGGSLRLSCAASGRTYAMGWERQAPGKEREEVANINALG
TRTYYADSVKGRFTISRDNSKNTLYLQMNSLRPEDTAVYYCTAQGQWRAAPV
AVAAEYEFWGWGTLVTVSS

SD3096
(SEQ ID NO: 154)
EVQLLESGGGLVWPGGSLRLSCAASGRTYAMGWERQAPGKEREEVANINALG
TRTYYADSVKGRFTISRDNSKNTVYLQMNSLRPEDTAVYYCTAQGQWRAAPV
AVAAEYEFWGWGTLVTVSS

SD3097
(SEQ ID NO: 155)
EVWLLESGGGLVWPGGSLRLSCAASGRTYAMGWFRQAPGKEREFVAAINALG
TRTYYADSVKGRFTISRDNSKNTLYLQMNSLRAEDTAVYYCTAQGQWRAAPV
AVAAEYEFWGWGTLVTVSS

SD3098
(SEQ ID NO: 156)
EVWLLESGGGLVWPGGSLRLSCAASGRTYAMGWFRQAPGKEREFVAAINALG
TRTYYADSVKGRFTISRDNSKNTLYLQMNSLRPEDTAVYYCTAQGQWRAAPV
AVAAEYEFWGWGTLVTVSS

SD1038 humanized variants

SD3013
(SEQ ID NO: 157)
EVQLVESGGGVVQPGGSLRLSCAASISIEDIYAMDWYRQAPGKQRELVATSF
RDGSTYYADSVKGRFTISRDNSKNTLYLQMNSLRAEDTAVYLCHVSLYRDPL
GVAGGMGVYWGKGALVTVSS

SD3014
(SEQ ID NO: 158)
EVQLVESGGGVVQPGGSLRLSCAASISIEDIYAMDWYRQAPGKQRELVAVSF
RDGSTYYADSVKGRFTISRDNSKNTLYLQMNSLRAEDTAVYLCHVSLYRDPL
GVAGGMGVYWGKGALVTVSS

SD3015
(SEQ ID NO: 159)
EVQLVESGGGVVQPGGSLRLSCAASISIEDIYAMDWYRQAPGKQRELVSVSF
RDGSTYYADSVKGRFTISRDNSKNTLYLQMNSLRAEDTAVYLCHVSLYRDPL
GVAGGMGVYWGKGALVTVSS

SD3016
(SEQ ID NO: 160)
EVQLVESGGGVVQPGGSLRLSCAASISIEDIYAMDWYRQAPGKQRELVAVSF
RDGSTYYADSVKGRFTISRDNSKNTLYLQMNSLRPEDTAVYLCHVSLYRDPL
GVAGGMGVYWGKGALVTVSS

SD3017
(SEQ ID NO: 161)
EVQLVESGGGVVQPGGSLRLSCAASISIEDIYAMHWYRQAPGKQRELVATSF
RDGSTYYADSVKGRFTISRDNSKNTLYLQMNSLRAEDTAVYLCHVSLYRDPL
GVAGGMGVYWGKGALVTVSS

SD3018
(SEQ ID NO: 162)
EVQLVESGGGVVQPGGSLRLSCAASISIEDIYAMHWYRQAPGKQRELVAVSF
RDGSTYYADSVKGRFTISRDNSKNTLYLQMNSLRAEDTAVYLCHVSLYRDPL
GVAGGMGVYWGKGALVTVSS

SD3019
(SEQ ID NO: 163)
EVQLVESGGGVVQPGGSLRLSCAASISIEDIYAMHWYRQAPGKQRELVSVSF
RDGSTYYADSVKGRFTISRDNSKNTLYLQMNSLRAEDTAVYLCHVSLYRDPL
GVAGGMGVYWGKGALVTVSS

SD3020
(SEQ ID NO: 164)
EVQLVESGGGVVQPGGSLRLSCAASISIEDIYAMHWYRQAPGKQRELVAVSF
RDGSTYYADSVKGRFTISRDNSKNTLYLQMNSLRPEDTAVYLCHVSLYRDPL
GVAGGMGVYWGKGALVTVSS

TABLE 40-continued

Sequences of humanized binding molecules of the invention

| | |
|---|---|
| SD3021<br>(SEQ ID NO: 165) | EVQLVESGGGVVQPGGSLRLSCAASISIEDIYAMDWYRQAPGKQRELVAVSF<br>RDGSTYYADSVKGRFTISRDNSKNTLYLQMNSLRPEDTAVYLCHVSLYRDPL<br>GVAGGLGVYWGKGALVTVSS |
| SD3022<br>(SEQ ID NO: 166) | EVQLVESGGGVVQPGGSLRLSCAASISIEDIYAMDWYRQAPGKQRELVAVSF<br>RDGSTYYADSVKGRFTISRDNSKNTLYLQMNSLRPEDTAVYLCHVSLYRDPL<br>GVAGGIGVYWGKGALVTVSS |
| SD3029<br>(SEQ ID NO: 167) | EVQLVESGGGLVQPGGSLRLSCAVSISIEDIYAMDWYRQAPGKQRDLVATSF<br>RDGSTNYADSVKGRFTISRDNAKNTLYLQMNSLKPEDTAVYLCHVSLYRDPL<br>GVAGGLGVYWGKGALVTVSS |
| SD3030<br>(SEQ ID NO: 168) | EVQLVESGGGLVQPGGSLRLSCAVSISIEDIYAMDWYRQAPGKQRDLVATSF<br>RDGSTNYADSVKGRFTISRDNAKNTLYLQMNSLKPEDTAVYLCHVSLYRDPL<br>GVAGGIGVYWGKGALVTVSS |
| SD3031<br>(SEQ ID NO: 169) | EVQLVESGGGLVQPGGSLRLSCAVSISIEDIYAMDWYRQAPGKQRDLVATSF<br>RDGSTNYADSVKGRFTISRDNAKNTLYLQMNSLKPEDTAVYLCHVSLYRDPL<br>GVAGGVGVYWGKGALVTVSS |
| SD3032<br>(SEQ ID NO: 170) | EVQLVESGGGLVQPGGSLRLSCAVSISIEDIYAMDWYRQAPGKQRDLVATSF<br>RDGSTNYADSVKGRFTISRDNAKNTLYLQMNSLKPEDTAVYLCHVSLYRDPL<br>GVAGGAGVYWGKGALVTVSS |
| SD3033<br>(SEQ ID NO: 171) | EVQLVESGGGLVQPGGSLRLSCAVSISIEDIYAMDWYRQAPGKQRDLVATSF<br>RDGSTNYADSVKGRFTISRDNAKNTLYLQMNSLKPEDTAVYLCHVSLYRDPL<br>GVAGGFGVYWGKGALVTVSS |
| SD3089<br>(SEQ ID NO: 172) | EVQLVESGGGVVQPGGSLRLSCAASISIEDIYAMHWYRQAPGKQRELVSVSF<br>RDGSTYYADSVKGRFTISRDNSKNTLYLQMNSLRAEDTAVYYCHVSLYRDPL<br>GVAGGLGVYWGQGTLVTVSS |
| SD3078<br>(SEQ ID NO: 173) | EVQLVESGGGVVQPGGSLRLSCAASISIEDIYAMDWYRQAPGKQRELVSVSF<br>RDGSTYYADSVKGRFTISRDNSKNTLYLQMNSLRAEDTAVYYCHVSLYRDPL<br>GVAGGLGVYWGQGTLVTVSS |
| SD3080<br>(SEQ ID NO: 174) | EVQLVESGGGVVQPGGSLRLSCAASISIEDIYAMDWYRQAPGKQRELVAVSF<br>RDGSTYYADSVKGRFTISRDNSKNTLYLQMNSLRPEDTAVYYCHVSLYRDPL<br>GVAGGLGVYWGQGTLVTVSS |
| SD3079<br>(SEQ ID NO: 175) | EVQLVESGGGVVQPGGSLRLSCAASISIEDIYAMDWYRQAPGKQRELVAVSF<br>RDGSTYYADSVKGRFTISRDNSKNTLYLQMNSLRAEDTAVYYCHVSLYRDPL<br>GVAGGLGVYWGQGTLVTVSS |
| SD3119<br>(SEQ ID NO: 176) | QVQLVESGGGVVQPGGSLRLSCAASISIEDIYAMDWYRQAPGKQRELVAVSF<br>RDGSTYYADSVKGRFTISRDNSKNTLYLQMNSLRAEDTAVYYCHVSLYRDPL<br>GVAGGIGVYWGQGTLVTVSS |

SD1046 humanized variants

| | |
|---|---|
| SD3041<br>(SEQ ID NO: 177) | EVQLVESGGGLVQPGGSLRLSCAASGRTLSIYSMSWFRQAPGKEREFVSAIG<br>WNSGRTYYADSVKGRFTISRDNSKNTLYLQMNSLRAEDTAVYYCAAAKGPLR<br>LSSQADYWGQGTQVTVSS |
| SD3042<br>(SEQ ID NO: 178) | EVQLVESGGGLVQPGGSLRLSCAASGRTLSIYSMSWFRQAPGKEREFVSTIG<br>WNSGRTYYADSVKGRFTISRDNSKNTLYLQMNSLRAEDTAVYYCAAAKGPLR<br>LSSQADYWGQGTQVTVSS |
| SD3043<br>(SEQ ID NO: 179) | EVQLVESGGGLVQPGGSLRLSCAASGRTLSIYSMSWFRQAPGKEREFVATIG<br>WNSGRTYYADSVKGRFTISRDNSKNTLYLQMNSLRAEDTAVYYCAAAKGPLR<br>LSSQADYWGQGTQVTVSS |
| SD3044<br>(SEQ ID NO: 180) | EVQLVESGGGLVQPGGSLRLSCAASGRTLSIYSMSWFRQAPGKEREFVSTIG<br>WNSGRTYYADSVKGRFTISRDNARNTLYLQMNSLRAEDTAVYYCAAAKGPLR<br>LSSQADYWGQGTQVTVSS |
| SD3045<br>(SEQ ID NO: 181) | EVQLVESGGGLVQAGGSLRLSCAASGRTLSIYSMSWFRQAPGKEREFVSAIG<br>WNSGRTYYADSVKGRFTISRDNSKNTLYLQMNSLRAEDTAVYYCAAAKGPLR<br>LSSQADYWGQGTQVTVSS |
| SD3046<br>(SEQ ID NO: 182) | EVQLVESGGGLVQAGGSLRLSCAASGRTLSIYSMSWFRQAPGKEREFVSTIG<br>WNSGRTYYADSVKGRFTISRDNSKNTLYLQMNSLRAEDTAVYYCAAAKGPLR<br>LSSQADYWGQGTQVTVSS |
| SD3047<br>(SEQ ID NO: 183) | EVQLVESGGGLVQAGGSLRLSCAASGRTLSIYSMSWFRQAPGKEREFVATIG<br>WNSGRTYYADSVKGRFTISRDNSKNTLYLQMNSLRAEDTAVYYCAAAKGPLR<br>LSSQADYWGQGTQVTVSS |

TABLE 40-continued

Sequences of humanized binding molecules of the invention

| | |
|---|---|
| SD3048<br>(SEQ ID NO: 184) | EVQLVESGGGLVQAGGSLRLSCAASGRTLSIYSMSWFRQAPGKEREFVSTIG<br>WNSGRTYYADSVKGRFTISRDNARNTLYLQMNSLRAEDTAVYYCAAAKGPLR<br>LSSQADYWGQGTQVTVSS |
| SD3068<br>(SEQ ID NO: 185) | EVQLVESGGGLVQPGGSLRLSCAASGRTLSIYSMGWFRQAPGKEREFVSTIG<br>WNSGRTFYPDSLKGRFTISRDNSKNTLYLQMNSLRAEDTAVYYCAAAKGPLR<br>LSSQADYWGQGTLVTVSS |
| SD3067<br>(SEQ ID NO: 186) | EVQLVESGGGLVQPGGSLRLSCAASGRTLSIYSMGWFRQAPGKEREFVATIG<br>WNSGRTFYPDSLKGRFTISRDNSKNTLYLQMNSLRAEDTAVYYCAAAKGPLR<br>LSSQADYWGQGTLVTVSS |
| SD3099<br>(SEQ ID NO: 187) | EVQLVESGGGLVQPGGSLRLSCAASGRTLSIYSMGWFRQAPGKEREFVATIG<br>WNSGRTFYPDSVKGRFTISRDNSKNTLYLQMNSLRAEDTAVYYCAAAKGPLR<br>LSSQADYWGQGTLVTVSS |
| SEQ ID NO: 340 | EVQLVESGGGLVQPGGSLRLSCAASGRTLSIYSMGWFRQAPGKEREFVATIG<br>WNSGRTFYPDSVKGRFTISRDNAKNTLYLQMNSLRAEDTAVYYCAAAKGPLR<br>LSSQADYWGQGTLVTVSS |

SD1083 humanized variants

| | |
|---|---|
| SD3005<br>(SEQ ID NO: 188) | EVQLLESGGGLVWPGGSLRLSCAASGFTLENKAMSWFRQAPGKEREGVSCIS<br>KSGSWTYYADSVKGRFTISRDNSKNTLYLQMNSLRAEDTAVYYCATTTAGGG<br>LCWDGTTFSRLASSWGQGTQVTVSS |
| SD3006<br>(SEQ ID NO: 189) | EVQLLESGGGLVWPGGSLRLSCAASGFTLENKAIGWFRQAPGKEREGVSCIS<br>KSGSWTYYADSVKGRFTISRDNSKNTLYLQMNSLRAEDTAVYYCATTTAGGG<br>LCWDGTTFSRLASSWGQGTQVTVSS |
| SD3007<br>(SEQ ID NO: 190) | EVQLLESGGGLVWPGGSLRLSCAASGFTLENKAIGWFRQAPGKEREGVSCIS<br>KSGSWTYYADSVKGRFTISRDNSKNTVYLQMNSLRAEDTAVYYCATTTAGGG<br>LCWDGTTFSRLASSWGQGTQVTVSS |
| SD3008<br>(SEQ ID NO: 191) | EVQLLESGGGLVWPGGSLRLSCAASGFTLENKAIGWFRQAPGKEREGVSCIS<br>KSGSWTYYADSVKGRFTISRDNSKNTVYLQMNSLRPEDTAVYYCATTTAGGG<br>LCWDGTTFSRLASSWGQGTQVTVSS |
| SD3009<br>(SEQ ID NO: 192) | EVQLLESGGGLVQPGGSLRLSCAASGFTLENKAMSWERQAPGKEREGVLCIS<br>KSGSWTYYADSVKGRFTISRDNSKNTLYLQMNSLRAEDTAVYYCATTTAGGG<br>LCWDGTTFSRLASSWGQGTQVTVSS |
| SD3010<br>(SEQ ID NO: 193) | EVQLLESGGGLVWPGGSLRLSCAASGFTLENKAIGWFRQAPGKEREGVLCIS<br>KSGSWTYYADSVKGRFTISRDNSKNTLYLQMNSLRAEDTAVYYCATTTAGGG<br>LCWDGTTFSRLASSWGQGTQVTVSS |
| SD3011<br>(SEQ ID NO: 194) | EVQLLESGGGLVWPGGSLRLSCAASGFTLENKAIGWFRQAPGKEREGVLCIS<br>KSGSWTYYADSVKGRFTISRDNSKNTVYLQMNSLRAEDTAVYYCATTTAGGG<br>LCWDGTTFSRLASSWGQGTQVTVSS |
| SD3012<br>(SEQ ID NO: 195) | EVQLLESGGGLVWPGGSLRLSCAASGFTLENKAIGWFRQAPGKEREGVLCIS<br>KSGSWTYYADSVKGRFTISRDNSKNTVYLQMNSLRPEDTAVYYCATTTAGGG<br>LCWDGTTFSRLASSWGQGTQVTVSS |
| SD3088<br>(SEQ ID NO: 196) | EVQLLESGGGLVWPGGSLRLSCAASGFTLENKAIGWFRQAPGKEREGVLCIS<br>KSGSWTYYADSVKGRFTISRDNSKNTLYLQMNSLRAEDTAVYYCATTTAGGG<br>LCWDGTTFSRLASSWGQGTLVTVSS |
| SD3087<br>(SEQ ID NO: 197) | EVQLLESGGGLVWPGGSLRLSCAASGFTLENKAIGWFRQAPGKEREGVLCIS<br>KSGSWTYYADSVKGRFTISRDNSKNTVYLQMNSLRPEDTAVYYCATTTAGGG<br>LCWDGTTFSRLASSWGQGTLVTVSS |

SD1084 humanized variants

| | |
|---|---|
| SD3001<br>(SEQ ID NO: 198) | EVQLVESGGGLVQPGGSLRLSCAASGFTESTSWMSWLRQAPGKGLEWVSVIN<br>TDGGTYYADSVKGRFTISRDNSKNTLYLQMNSLRAEDTAVYYCAKDWGGPEP<br>TRGQGTQVTVSS |
| SD3002<br>(SEQ ID NO: 199) | EVQLVESGGGLVQPGGSLRLSCAASGFTESTSWMYWLRQAPGKGLEWVSVIN<br>TDGGTYYADSVKGRFTISRDNSKNTLYLQMNSLRAEDTAVYYCAKDWGGPEP<br>TRGQGTQVTVSS |
| SD3003<br>(SEQ ID NO: 200) | EVQLVESGGGLVQPGGSLRLSCAASGFTESTSWNSWLRQAPGKGLEWVSVIN<br>TDGGTYYADSVKGRFTISRDNSKDTLYLQMNSLRAEDTAVYYCAKDWGGPEP<br>TRGQGTQVTVSS |

TABLE 40-continued

Sequences of humanized binding molecules of the invention

| | |
|---|---|
| SD3004 (SEQ ID NO: 201) | EVQLVESGGGLVQPGGSLRLSCAASGFTESTSWMYWLRQAPGKGLEWVSVIN TDGGTYYADSVKGRFTISRDNSKDTLYLQMNSLRAEDTAVYYCAKDWGGPEP TRGQGTQVTVSS |
| SD3086 (SEQ ID NO: 202) | EVQLVESGGGLVQPGGSLRLSCAASGFTESTSWMYWVRQAPGKGLEWVSVIN TDGGTYYADSVKGRFTISRDNSKNTLYLQMNSLRAEDTAVYYCAKDWGGPEP TRGQGTLVTVSS |
| SD3085 (SEQ ID NO: 203) | EVQLVESGGGLVQPGGSLRLSCAASGFTESTSWMYWLRQAPGKGLEWVSVIN TDGGTYYADSVKGRFTISRDNSKNTLYLQMNSLRAEDTAVYYCAKDWGGPEP TRGQGTLVTVSS |

SD1087 humanized variants

| | |
|---|---|
| SD3049 (SEQ ID NO: 204) | EVQLVESGGGLVWPGGSLRLSCAASGLSLDTYAMSWFRQAPGKEREGVSCIS SGHGMTYYADSVKGRFTISRDNSKNTLYLQMNSLWPEDTARYYCATESRYYC SDNWPAPQRYIYWGWGTQVTVSS |
| SD3050 (SEQ ID NO: 205) | EVQLVESGGGLVWPGGSLRLSCAASGLSLDTYAMSWFRQAPGKEREGITCIS SGHGMTYYADSVKGRFTISRDNSKNTLYLQMNSLWPEDTARYYCATESRYYC SDNWPAPQRYIYWGWGTQVTVSS |
| SD3051 (SEQ ID NO: 206) | EVQLVESGGGLVWPGGSLRLSCAASGLSLDTYAMSWFRQAPGKEREGVSCIS SGHGITYYADSVKGRFTISRDNSKNTLYLQMNSLWPEDTARYYCATESRYYC SDNWPAPQRYIYWGWGTQVTVSS |
| SD3052 (SEQ ID NO: 207) | EVQLVESGGGLVWPGGSLRLSCAASGLSLDTYAMSWFRQAPGKEREGVSCIS SGHGLTYYADSVKGRFTISRDNSKNTLYLQMNSLWPEDTARYYCATESRYYC SDNWPAPQRYIYWGWGTQVTVSS |
| SD3053 (SEQ ID NO: 208) | EVQLVESGGGLVWPGGSLRLSCAASGLSLDTYAMSWFRQAPGKEREGVSCIS SGHGETYYADSVKGRFTISRDNSKNTLYLQMNSLWPEDTARYYCATESRYYC SDNWPAPQRYIYWGWGTQVTVSS |
| SD3054 (SEQ ID NO: 209) | EVQLVESGGGLVWPGGSLRLSCAASGLSLDTYAMSWFRQAPGKEREGITCIS SGHGITYYADSVKGRFTISRDNSKNTLYLQMNSLWPEDTARYYCATESRYYC SDNWPAPQRYIYWGWGTQVTVSS |
| SD3055 (SEQ ID NO: 210) | EVQLVESGGGLVWPGGSLRLSCAASGLSLDTYAMSWFRQAPGKEREGITCIS SGHGLTYYADSVKGRFTISRDNSKNTLYLQMNSLWPEDTARYYCATESRYYC SDNWPAPQRYIYWGWGTQVTVSS |
| SD3056 (SEQ ID NO: 211) | EVQLVESGGGLVWPGGSLRLSCAASGLSLDTYAMSWFRQAPGKEREGITCIS SGHGETYYADSVKGRFTISRDNSKNTLYLQMNSLWPEDTARYYCATESRYYC SDNWPAPQRYIYWGWGTQVTVSS |
| SD3069 (SEQ ID NO: 212) | EVQLVESGGGLVWPGGSLRLSCAISGLSLDTYAVGWFRQAPGKEREGITCIS SGHGMTYYADSVKGRFTVSTDNSKNTLYLQMNSLRAEDTAVYYCATESRYYC SDNWPAPQRYIYWGWGTLVTVSS |
| SD3070 (SEQ ID NO: 213) | EVQLVESGGGLVWPGGSLRLSCAISGLSLDTYAVGWFRQAPGKEREGITCIS SGHGITYYADSVKGRFTVSTDNSKNTLYLQMNSLRAEDTAVYYCATESRYYC SDNWPAPQRYIYWGWGTLVTVSS |
| SD3071 (SEQ ID NO: 214) | EVQLVESGGGLVWPGGSLRLSCAISGLSLDTYAVGWFRQAPGKEREGITCIS SGHGLTYYADSVKGRFTVSTDNSKNTLYLQMNSLRAEDTAVYYCATESRYYC SDNWPAPQRYIYWGWGTLVTVSS |
| SD3072 (SEQ ID NO: 215) | EVQLVESGGGLVWPGGSLRLSCAASGLSLDTYAVGWFRQAPGKEREGITCIS SGHGMTYYADSVKGRFTVSTDNSKNTLYLQMNSLRAEDTAVYYCATESRYYC SDNWPAPQRYIYWGWGTLVTVSS |
| SD3073 (SEQ ID NO: 216) | EVQLVESGGGLVWPGGSLRLSCAISGLSLDTYAVGWFRQAPGKEREGVSCIS SGHGMTYYADSVKGRFTVSTDNSKNTLYLQMNSLRAEDTAVYYCATESRYYC SDNWPAPQRYIYWGWGTLVTVSS |
| SD3074 (SEQ ID NO: 217) | EVQLVESGGGLVWPGGSLRLSCAISGLSLDTYAVGWFRQAPGKEREGITCIS SGHGMTYYADSVKGRFTISTDNSKNTLYLQMNSLRAEDTAVYYCATESRYYC SDNWPAPQRYIYWGWGTLVTVSS |
| SD3075 (SEQ ID NO: 218) | EVQLVESGGGLVWPGGSLRLSCAASGLSLDTYAVGWFRQAPGKEREGVSCIS SGHGITYYADSVKGRFTISTDNSKNTLYLQMNSLRAEDTAVYYCATESRYYC SDNWPAPQRYIYWGWGTLVTVSS |
| SD3076 (SEQ ID NO: 219) | EVQLVESGGGLVWPGGSLRLSCAASGLSLDTYAVGWFRQAPGKEREGVSCIS SGHGLTYYADSVKGRFTISTDNSKNTLYLQMNSLRAEDTAVYYCATESRYYC SDNWPAPQRYIYWGWGTLVTVSS |

TABLE 40-continued

Sequences of humanized binding molecules of the invention

SD3092
(SEQ ID NO: 220)
EVQLVESGGGLVWPGGSLRLSCAISGLSLDTYAVGWFRQAPGKEREGVSCIS
SGHGMTYYADSVKGRFTISTDNSKNTLYLQMNSLRAEDTAVYYCATESRYYC
SDNWPAPQRYIYWGWGTLVTVSS

SD3093
(SEQ ID NO: 221)
EVQLVESGGGLVWPGGSLRLSCAISGLSLDTYAVGWFRQAPGKEREGVSCIS
SGHGMTYYADSVKGRFTISTDNSKNTVYLQMNSLRAEDTAVYYCATESRYYC
SDNWPAPQRYIYWGWGTLVTVSS

SD3100
(SEQ ID NO: 222)
EVQLVESGGGLVWPGGSLRLSCAISGLSLDTYAVGWFRQAPGKEREGVSCIS
SGHGATYYADSVKGRFTISTDNSKNTLYLQMNSLRAEDTAVYYCATESRYYC
SDNWPAPQRYIYWGWGTLVTVSS

SD3101
(SEQ ID NO: 223)
EVQLVESGGGLVWPGGSLRLSCAISGLSLDTYAVGWFRQAPGKEREGVSCIS
SGHGSTYYADSVKGRFTISTDNSKNTLYLQMNSLRAEDTAVYYCATESRYYC
SDNWPAPQRYIYWGWGTLVTVSS

SD3102
(SEQ ID NO: 224)
EVQLVESGGGLVWPGGSLRLSCAISGLSLDTYAVGWFRQAPGKEREGVSCIS
SGHGQTYYADSVKGRFTISTDNSKNTLYLQMNSLRAEDTAVYYCATESRYYC
SDNWPAPQRYIYWGWGTLVTVSS

SD3103
(SEQ ID NO: 225)
EVQLVESGGGLVWPGGSLRLSCAISGLSLDTYAVGWFRQAPGKEREGVSCIS
SGHGDTYYADSVKGRFTISTDNSKNTLYLQMNSLRAEDTAVYYCATESRYYC
SDNWPAPQRYIYWGWGTLVTVSS

SD3104
(SEQ ID NO: 226)
EVQLVESGGGLVWPGGSLRLSCAISGLSLDTYAVGWFRQAPGKEREGVSCIS
SGHGNTYYADSVKGRFTISTDNSKNTLYLQMNSLRAEDTAVYYCATESRYYC
SDNWPAPQRYIYWGWGTLVTVSS

TABLE 41

Average neutralization titers (nM), HEK293 expression levels, temperature stability and sequence characteristics of humanized influenza B sdAbs (empty cells mean 'not determined')

| | VNA IC$_{50}$ (nM) | | | | | | Expression | | # FR | |
|---|---|---|---|---|---|---|---|---|---|---|
| ID | B/Brisbane/60/80 | B/Malaysia/2506/04 | B/Florida/04/06 | B/Harbin/7/94 | B/Massachusetts/2/12 | B/Lee/40 | level (mg/l culture medium) | T$_m$ onset (° C.) | mutations vs germline | % identity in FRs |
| SD1083 | 174 | 256 | 290 | 303 | 260 | 215 | | 57.6 | 19 | 79% |
| SD3005 | | | | | | | 0 | | 5 | 94% |
| SD3006 | | | | | | | 0 | | 5 | 94% |
| SD3007 | >1000 | | | >1000 | | >1000 | 15 | | 6 | 93% |
| SD3008 | >1000 | | | >1000 | | >1000 | 157 | | 7 | 92% |
| SD3009 | 194 | | | 516 | | 372 | 6 | | 6 | 93% |
| SD3010 | 149 | | | 173 | | 227 | 15 | 57.9 | 6 | 93% |
| SD3011 | 53 | | | 96 | | 59 | 20 | 71.0 | 7 | 92% |
| SD3012 | 59 | | | 78 | | 60 | 132 | 74.3 | 8 | 91% |
| SD3087 | 32 | 81 | 160 | 201 | 104 | 91 | 161 | 75.1 | 7 | 92% |
| SD3088 | 101 | | | | | 127 | 9 | 58.7 | 5 | 94% |
| SD1084 | 12 | 26 | 68 | 322 | 35 | >1000 | | 56.7 | 10 | 89% |
| SD3001 | 101 | | | >1000 | | >1000 | 67 | | 3 | 97% |
| SD3002 | 5 | | | 137 | | >1000 | 50 | 65.3 | 3 | 97% |
| SD3003 | 101 | | | >1000 | | >1000 | 68 | | 4 | 96% |
| SD3004 | 5 | | | 101 | | >1000 | 71 | 62.2 | 4 | 96% |
| SD3085 | 12 | 13 | 64 | 228 | 32 | >1000 | 133 | 66.2 | 2 | 98% |
| SD3086 | 40 | | | | | >1000 | 99 | 62.1 | 1 | 99% |
| SD1087 | 34 | 59 | >1000 | >1000 | 1000 | 22 | | 74.7 | 17 | 81% |
| SD3049 | >1000 | | | >1000 | | | 32 | 68 | 8 | 91% |
| SD3050 | >1000 | | | >1000 | | | 53 | 66.5 | 10 | 89% |
| SD3051 | >1000 | | | >1000 | | | 62 | | 8 | 91% |
| SD3052 | >1000 | | | >1000 | | | 57 | | 8 | 91% |
| SD3053 | >1000 | | | >1000 | | | 29 | | 8 | 91% |
| SD3054 | >1000 | | | >1000 | | | 60 | 65.7 | 10 | 89% |
| SD3055 | >1000 | | | >1000 | | | 48 | 66.2 | 10 | 89% |
| SD3056 | >1000 | | | >1000 | | | 26 | | 10 | 89% |
| SD3069 | 56 | | | >1000 | | 67 | 40 | 69.7 | 9 | 90% |
| SD3070 | >1000 | | | >1000 | | >1000 | 26 | 70.9 | 9 | 90% |
| SD3071 | >1000 | | | >1000 | | >1000 | 29 | 69.6 | 9 | 90% |
| SD3072 | 160 | | | >1000 | | 318 | 20 | 65.2 | 8 | 91% |
| SD3073 | 28 | | | >1000 | | 59 | 35 | 69.1 | 7 | 92% |
| SD3074 | 36 | | | >1000 | | 42 | 27 | 66.2 | 8 | 91% |
| SD3075 | >1000 | | | >1000 | | >1000 | 7 | 61.5 | 5 | 94% |
| SD3076 | >1000 | | | >1000 | | >1000 | 6 | 61.1 | 5 | 94% |

TABLE 41-continued

Average neutralization titers (nM), HEK293 expression levels, temperature stability and sequence characteristics of humanized influenza B sdAbs (empty cells mean 'not determined')

| ID | VNA IC$_{50}$ (nM) | | | | | | Expression level (mg/l culture medium) | T$_m$ onset (° C.) | # FR mutations vs germline | % identity in FRs |
|---|---|---|---|---|---|---|---|---|---|---|
| | B/ Brisbane/ 60/80 | B/ Malaysia/ 2506/04 | B/ Florida/ 04/06 | B/ Harbin/ 7/94 | B/ Massachusetts/ 2/12 | B/Lee/ 40 | | | | |
| SD3092 | 51 | 40 | >1000 | >1000 | >1000 | 40 | 18 | 64.0 | 6 | 93% |
| SD3093 | 32 | 40 | 659 | >1000 | 795 | 32 | 21 | 69.4 | 7 | 92% |
| SD3100 | >1000 | | | >1000 | | >1000 | 30 | | 6 | 93% |
| SD3101 | >1000 | | | >1000 | | >1000 | 29 | | 6 | 93% |
| SD3102 | >1000 | | | >1000 | | >1000 | 36 | | 6 | 93% |
| SD3103 | >1000 | | | >1000 | | >1000 | 43 | | 6 | 93% |
| SD3104 | >1000 | | | >1000 | | >1000 | 31 | | 6 | 93% |

TABLE 42

Average neutralization titers (nM), HEK293 expression levels, temperature stability and sequence characteristics of humanized influenza A sdAbs SD1036 and SD1046 (empty cells mean 'not determined')

| ID | VNA IC$_{50}$ (nM) | | | | | | Expression level (mg/l culture medium) | T$_m$ onset (° C.) | # FR mutations vs germline | % identity in FRs |
|---|---|---|---|---|---|---|---|---|---|---|
| | A/ Brisbane/ 10/07 | A/ Hong Kong/ 1/68-ma | A/ waterfowl/ Hong Kong/ MPA892/ 06 | A/ mallard/ Netherlands/ 12/00 | A/ New York/ 107/03 (PR8) | A/ chicken/ Germany/ n/49 | | | | |
| SD1036 | 59 | 78 | 44 | 6 | 11 | 10 | | 56.5 | 16 | 82% |
| SD3023 | 64 | 206 | | 5 | 16 | | 113 | | 7 | 92% |
| SD3024 | 80 | 206 | | 8 | 20 | | 40 | 51.5 | 5 | 94% |
| SD3025 | 160 | 280 | | 5 | 13 | | 122 | 59.8 | 6 | 93% |
| SD3026 | 16 | 36 | | 3 | 8 | | 59 | 58.5 | 5 | 94% |
| SD3027 | 16 | 30 | | 5 | 6 | | 106 | | 7 | 92% |
| SD3028 | 101 | 280 | | 6 | 26 | | 114 | | 8 | 91% |
| SD3094 | 8 | 20 | | <4 | 6 | | 59 | 60.8 | 5 | 94% |
| SD3095 | 8 | 26 | | <4 | 6 | | 102 | 64.1 | 6 | 93% |
| SD3096 | 26 | 20 | | <4 | 5 | | 121 | 66.2 | 7 | 92% |
| SD3097 | 17 | 32 | 6 | 6 | 8 | 6 | 79 | 70.5 | 5 | 94% |
| SD3098 | 4 | 20 | | <4 | 16 | | 114 | 74.2 | 6 | 93% |
| SD1046 | 5 | 26 | 3 | 25 | 34 | 13 | | 58.3 | 16 | 82% |
| SD3041 | | 858 | | >1000 | >1000 | | 134 | | 5 | 94% |
| SD3042 | | 253 | | >1000 | >1000 | | 100 | 63.8 | 5 | 94% |
| SD3043 | | 466 | | >1000 | >1000 | | 89 | 71.2 | 6 | 93% |
| SD3044 | | 253 | | >1000 | >1000 | | 138 | | 7 | 92% |
| SD3045 | | 632 | | >1000 | >1000 | | 92 | | 6 | 93% |
| SD3046 | | 253 | | >1000 | >1000 | | 92 | | 6 | 93% |
| SD3047 | | 253 | | >1000 | >1000 | | 94 | | 7 | 92% |
| SD3048 | | 343 | | >1000 | 858 | | 36 | | 8 | 91% |
| SD3067 | 3 | 8 | | 10 | 16 | | 101 | 63.3 | 8 | 91% |
| SD3068 | 4 | 10 | | 10 | 26 | | 107 | 55.9 | 7 | 92% |
| SD3099 | 3 | 3 | 2 | 26 | 16 | 5 | 98 | 63.5 | 7 | 92% |

TABLE 43

Average neutralization titers (nM), HEK293 expression levels, temperature stability and sequence characteristics of humanized influenza A sdAb SD1038 (empty cells mean 'not determined')

| ID | VNA IC$_{50}$ (nM) | | | | | | Expression level (mg/l culture medium) | T$_m$ onset (° C.) | # FR mutations vs germline | % identity in FRs |
|---|---|---|---|---|---|---|---|---|---|---|
| | A/ California/ 07/09 | A/ New Caledonia 20/99 | A/ Puerto Rico/ 34-ma | A/ Vietnam 1194/ 04/ | A/ Brisbane 10/07 | A/ Hong Kong 1/68 | | | | |
| SD1038 | 2 | 7 | 10 | 15 | 284 | 251 | | 60.4 | 17 | 81% |
| SD3013 | | 6 | 8 | 20 | 318 | 126 | 109 | | 10 | 89% |
| SD3014 | | 3 | 4 | 11 | | | 97 | 72 | 10 | 89% |
| SD3015 | | 3 | 3 | 6 | | | 46 | 63.7 | 9 | 90% |
| SD3016 | | 3 | 3 | 8 | | | 99 | 74.5 | 11 | 88% |
| SD3017 | | 4 | 6 | 11 | | | 150 | | 10 | 89% |

TABLE 43-continued

Average neutralization titers (nM), HEK293 expression levels, temperature stability and sequence characteristics of humanized influenza A sdAb SD1038 (empty cells mean 'not determined')

| ID | VNA IC$_{50}$ (nM) | | | | | | Expression level (mg/l culture medium) | T$_m$ onset (° C.) | # FR mutations vs germline | % identity in FRs |
|---|---|---|---|---|---|---|---|---|---|---|
| | A/ California/ 07/09 | A/ New Caledonia 20/99 | A/ Puerto Rico/ 34-ma | A/ Vietnam 1194/ 04/ | A/ Brisbane 10/07 | A/ Hong Kong 1/68 | | | | |
| SD3018 | | 6 | 3 | 8 | | | 84 | 69.6 | 10 | 89% |
| SD3019 | | 4 | 6 | 8 | | | 49 | 60.3 | 9 | 90% |
| SD3020 | | 4 | 4 | 15 | | | 93 | 72.6 | 11 | 88% |
| SD3021 | 3 | 3 | 3 | 15 | >1000 | | 80 | 73.4 | 11 | 88% |
| SD3022 | 3 | 8 | 6 | 20 | 632 | | 96 | | 11 | 88% |
| SD3029 | 3 | 4 | 2 | 20 | 632 | 251 | 22 | | 17 | 81% |
| SD3030 | 3 | 8 | 6 | 20 | 274 | 126 | 37 | | 17 | 81% |
| SD3031 | | 37 | 15 | 51 | >1000 | | 19 | | 17 | 81% |
| SD3032 | | >500 | >500 | >500 | | | 17 | | 17 | 81% |
| SD3033 | | 51 | 51 | 316 | | | 11 | | 17 | 81% |
| SD3078 | | 8 | 3 | 20 | 632 | | 81 | 68.6 | 6 | 93% |
| SD3079 | | 5 | 3 | 16 | 949 | 503 | 85 | 75.3 | 7 | 92% |
| SD3080 | | 5 | 3 | 16 | 632 | | 89 | 78.6 | 8 | 91% |
| SD3089 | | 3 | 2 | 20 | 1188 | | 87 | 66.2 | 6 | 93% |
| SD3119 | | 3 | | 6 | 253 | 101 | | 75.3 | 6 | 93% |

Humanization of SD1036:
For SD1036 11 humanized variants were made. Several of these variants showed equal or in some cases even better neutralizing activity than the parent sdAb. No major differences in expression levels were observed, whereas for the majority of SD1036 variants the onset temperature of melting was increased. Variant SD3097 was selected as final humanized variant because it has the lowest number of FR mutations vs human germline, a high T$_m$ onset value and in addition shows potent neutralization of all group 2 influenza strains tested.

Humanization of SD1038:
For SD1038 21 humanized variants were made. All variants, except SD3031-33, showed similar neutralizing activity against 4 group 1 strains as the parent sdAb. IC$_{50}$ values for H3 strains A/Brisbane/10/07 and A/Hong Kong/1/68 were slightly higher for most of the SD1038 variants. Variant SD3119 was selected as final humanized variant because it has the lowest number of FR mutations vs human germline, a high T$_m$ onset value and shows potent neutralization of all influenza strains tested. In this variant Met in CDR3 is replaced by Ile.

Humanization of SD1046:
For SD1046 11 humanized variants were made. A first series of variants showed strongly reduced neutralizing activity compared to the parent sdAb. A second series of variants was made which showed very similar activity as SD1046 in VNA. Of these variants, SD3099 was selected as final humanized variant because it has the lowest number of FR mutations vs human germline and shows high temperature stability.

Humanization of SD1083:
For SD1083 10 humanized variants were made. Several of these variants showed low expression levels in HEK293 cells and 2 did not express at all. Of the 3 variants that expressed well, SD3087 was selected as final humanized variant. This sdAb is more potent than the parent SD1083 in VNA and has a substantially higher T$_m$ onset value.

Humanization of SD1084:
For SD1084 6 humanized variants were made. Four of these variants showed similar neutralizing activity in VNA as the parent sdAb. Of these variants, SD3085 was selected as final humanized variant because it has the highest T$_m$ onset value and only 2 FR mutations vs human germline.

Humanization of SD1087:
For SD1087 23 humanized variants were made. A first series of 8 variants showed no measurable activity in VNA against 2 influenza B strains. A second series of SDAbs was made which included a number of variants showing similar IC$_{50}$ values as SD1087. The temperature stability of these variants was lower than that of the parent molecule. None of the variants containing a substitution of Met in CDR2 showed activity in VNA. SD3093 was selected as final humanized variant because it showed only a modest decrease in T$_m$ onset value and its activity in VNA was equal to that of SD1087.

Example 12: Generation and Characterization of Humanized sdAb Multimer Fc Fusion Constructs Generation of Fc Fusion Constructs The humanized sdAb variants described in Example 11 were used to generate multimeric Fc fusion constructs. The humanized multimeric binding molecules, i.e. multimeric binding molecules comprising at least two humanized sdAbs, were fused directly to the N-terminus of the Fc region. The Fc-fusion constructs were expressed in mammalian cells and secreted into the medium as dimeric Fc molecules. Complete amino acid sequences of the Fc fusion constructs are shown in Table 44. Homodimeric as well as heterodimeric Fc-fusion molecules were generated. Heterodimeric Fc fusions were generated by introducing single point mutations (K409R and F405L) in the CH3 domain of the 2 Fc chains as described by Labrijn et al. (2013) or by introducing the knobs-into-holes mutations as described in EP0812357B1 and EP0979281B1.

Gene constructs encoding humanized sdAb multimer Fc fusion proteins were codon optimized for mammalian cell expression and incorporated into Lonza pEE12.4 vectors. The expression vectors (that utilize the CD4 HC signal peptide) were amplified, purified, and concentrated to a final concentration of >5 mg/mL in sterile water for transfection of CHO cell lines using electroporation. Heterodimeric Fc fusion proteins were produced by co-transfection of equal amounts of vectors encoding the 2 individual chains. Homodimeric Fc fusions were produced using a single vector construct as noted above. The cell cultures were grown using standard suspension phase shake flask procedures. The filtered culture supernatants were applied to HiTrap MabSelect SuRe columns, washed with PBS, eluted with 0.1M sodium acetate pH 3.5, neutralized using 2.5M Tris pH 7.2, and dialyzed into dPBS.

TABLE 44

Amino acid sequences of humanized sdAb multimer Fc fusion constructs

| | | |
|---|---|---|
| FM1W3 | QVQLVESGGGVVWPGGSLRLSCAASISIFDIYAMDWYRQAPGKQRELVAVSFRDGSTYYA DSVKGRFTISRDNSKNTLYLQMNSLRAEDTAVYYCHVSLYRDPLGVAGGIGVYWGQGTLV TVSSGGGGSGGGGSEVQLLESGGGLVWPGGSLRLSCAASGRTYAMGWFRQAPGKEREFVA AINALGTRTYYADSVKGRFTISRDNSKNTLYLQMNSLRAEDTAVYYCTAQGQWRAAPVAV AAEYEFWGQGTLVTVSSGGGGSGGGGSEVQLLESGGGLVQPGGSLRLSCAASGFTLENKA IGWFRQAPGKEREGVLCISKSGSWTYYADSVKGRFTISRDNSKNTVYLQMNSLRPEDTAV YYCATTTAGGGLCWDGTTFSRLASSWGQGTLVTVSSGGGGSGGGGSEVQLVESGGGLVQP GGSLRLSCAASGFTSTSWMYWLRQAPGKGLEWVSVINTDGGTYYADSVKGRFTISRDNS KNTLYLQMNSLRAEDTAVYYCAKDWGGPEPTRGQGTLVTVSSDKTHTCPPCPAPELLGGP SVFLFPPKPKDTLMISRTPEVTCVVVDVSHEDPEVKFNWYVDGVEVHNAKTKPREEQYNS TYRVVSVLTVLHQDWLNGKEYKCKVSNKALPAPIEKTISKAKGQPREPQVYTLPPSREEM TKNQVSLTCLVKGFYPSDIAVEWESNGQPENNYKTTPPVLDSDGSFFLYSKLTVDKSRWQ WGNVFSCSVMHEALHNHYTQKSLSLSPGK | SEQ ID NO: 293 |
| FM1W4 | EVQLLESGGGLVQPGGSLRLSCAASGFTLENKAIGWFRQAPGKEREGVLCISKSGSWTYY ADSVKGRFTISRDNSKNTVYLQMNSLRPEDTAVYYCATTTAGGGLCWDGTTFSRLASSWG QGTLVTVSSGGGGSGGGGSQVQLVESGGGVVQPGGSLRLSCAASISIFDIYAMDWYRQAP GKQRELVAVSFRDGSTYYADSVKGRFTISRDNSKNTLYLQMNSLRAEDTAVYYCHVSLYR DPLGVAGGIGVYWGQGTLVTVSSGGGGSGGGGSEVQLVESGGGLVQPGGSLRLSCAASGF TFSTSWMYWLRQAPGKGLEWVSVINTDGGTYYADSVKGRFTISRDNSKNTLYLQMNSLRA EDTAVYYCAKDWGGPEPTRGQGTLVTVSSGGGGSGGGGSEVQLLESGGGLVQPGGSLRLS CAASGRTYAMGWFRQAPGKEREFVAAINALGTRTYYADSVKGRFTISRDNSKNTLYLQMN SLRAEDTAVYYCTAQGQWRAAPVAVAAEYEFWGQGTLVTVSSDKTHTCPPCPAPELLGGP SVFLFPPKPKDTLMISRTPEVTCVVVDVSHEDPEVKFNWYVDGVEVHNAKTKPREEQYNS TYRVVSVLTVLHQDWLNGKEYKCKVSNKALPAPIEKTISKAKGQPREPQVYTLPPSREEM TKNQVSLTCLVKGFYPSDIAVEWESNGQPENNYKTTPPVLDSDGSFFLYSKLTVDKSRWQ WGNVFSCSVMHEALHNHYTQKSLSLSPGK | SEQ ID NO: 294 |
| FM1W5 | QVQLVESGGGVVWPGGSLRLSCAASISIFDIYAMDWYRQAPGKQRELVAVSFRDGSTYYA DSVKGRFTISRDNSKNTLYLQMNSLRAEDTAVYYCHVSLYRDPLGVAGGIGVYWGQGTLV TVSSGGGGSGGGGSEVQLVESGGGLVWPGGSLRLSCAASGRTLSIYSMGWFRQAPGKERE FVATIGWNSGRTFYPDSVKGRFTISRDNSKNTLYLQMNSLRAEDTAVYYCAAAKGPLRLS SQADYWGQGTLVTVSSGGGGSGGGGSEVQLLESGGGLVQPGGSLRLSCAASGFTLENKAI GWFRQAPGKEREGVLCISKSGSWTYYADSVKGRFTISRDNSKNTVYLQMNSLRPEDTAVY YCATTTAGGGLCWDGTTFSRLASSWGQGTLVTVSSGGGGSGGGGSEVQLVESGGGLVQPG GSLRLSCAASGFTSTSWMYWLRQAPGKGLEWVSVINTDGGTYYADSVKGRFTISRDNSK NTLYLQMNSLRAEDTAVYYCAKDWGGPEPTRGQGTLVTVSSDKTHTCPPCPAPELLGGPS VFLFPPKPKDTLMISRTPEVTCVVVDVSHEDPEVKFNWYVDGVEVHNAKTKPREEQYNST YRVVSVLTVLHQDWLNGKEYKCKVSNKALPAPIEKTISKAKGWPREPQVYTLPPSREEMT KNQVSLTCLVKGFYPSDIAVEWESNGQPENNYKTTPPVLDSDGSFFLYSKLTVDKSRWQQ GNVFSCSVMHEALHNHYTQKSLSLSPGK | SEQ ID NO: 295 |
| FM1W6 | EVQLVESGGGLVWPGGSLRLSCAASGRTLSIYSMGWFRQAPGKEREFVATIGWNSGRTFY PDSVKGRFTISRDNSKNTLYLQMNSLRAEDTAVYYCAAAKGPLRLSSQADYWGQGTLVTV SSGGGGSGGGGSQVQLVESGGGVVWPGGSLRLSCAASISIFDIYAMDWYRQAPGKQRELV AVSFRDGSTYYADSVKGRFTISRDNSKNTLYLQMNSLRAEDTAVYYCHVSLYRDPLGVAG GIGVYWGQGTLVTVSSGGGGSGGGGSEVQLVESGGGLVQPGGSLRLSCAASGFTFSTSWM YWLRQAPGKGLEWVSVINTDGGTYYADSVKGRFTISRDNSKNTLYLQMNSLRAEDTAVYY CAKDWGGPEPTRGQGTLVTVSSGGGGSGGGGSEVQLLESGGGLVQPGGSLRLSCAASGFT LENKAIGWFRQAPGKEREGVLCISKSGSWTYYADSVKGRFTISRDNSKNTVYLQMNSLRP EDTAVYYCATTTAGGGLCWDGTTFSRLASSWGQGTLVTVSSDKTHTCPPCPAPELLGGPS VFLFPPKPKDTLMISRTPEVTCVVVDVSHEDPEVKFNWYVDGVEVHNAKTKPREEQYNST YRVVSVLTVLHQDWLNGKEYKCKVSNKALPAPIEKTISKAKGWPREPQVYTLPPSREEMT KNQVSLTCLVKGFYPSDIAVEWESNGQPENNYKTTPPVLDSDGSFFLYSKLTVDKSRWQQ GNVFSCSVMHEALHNHYTQKSLSLSPGK | SEQ ID NO: 296 |
| FM1W7 | QVQLVESGGGVVWPGGSLRLSCAASISIFDIYAMDWYRQAPGKQRELVAVSFRDGSTYYA DSVKGRFTISRDNSKNTLYLQMNSLRAEDTAVYYCHVSLYRDPLGVAGGIGVYWGQGTLV TVSSGGGGSGGGGSEVQLVESGGGLVWPGGSLRLSCAASGRTLSIYSMGWFRQAPGKERE FVATIGWNSGRTFYPDSVKGRFTISRDNSKNTLYLQMNSLRAEDTAVYYCAAAKGPLRLS SQADYWGQGTLVTVSSGGGGSGGGGSEVQLLESGGGLVWPGGSLRLSCAISGLSLDTYAV GWFRQAPGKEREGVSCISSGHGMTYYADSVKGRFTISTDNSKNTVYLQMNSLRAEDTAVY YCATESRYYCSDNWPAPQRYIYWGQGTLVTVSSGGGGSGGGGSEVQLVESGGGLVQPGGS LRLSCAASGFTFSTSWMYWLRQAPGKGLEWVSVINTDGGTYYADSVKGRFTISRDNSKNT LYLQMNSLRAEDTAVYYCAKDWGGPEPTRGQGTLVTVSSDKTHTCPPCPAPELLGGPSVF LFPPKPKDTLMISRTPEVTCVVVDVSHEDPEVKFNWYVDGVEVHNAKTKPREEQYNSTYR VVSVLTVLHQDWLNGKEYKCKVSNKALPAPIEKTISKAKGWPREPQVYTLPPSREEMTKN QVSLTCLVKGFYPSDIAVEWESNGQPENNYKTTPPVLDSDGSFFLYSKLTVDKSRWQQGN VFSCSVMHEALHNHYTQKSLSLSPGK | SEQ ID NO: 297 |

TABLE 44-continued

Amino acid sequences of humanized sdAb multimer Fc fusion constructs

| | | |
|---|---|---|
| FM1W8 | EVQLVESGGGLVWPGGSLRLSCAISGLSLDTYAVGWFRQAPGKEREGVSCISSGHGMTYY<br>ADSVKGRFTISTDNSKNTVYLQMNSLRAEDTAVYYCATESRYYCSDNWPAPQRYIYWGQG<br>TLVTVSSGGGGSGGGGSEVQLVESGGGLVQPGGSLRLSCAASGFTFSTSWMYWLRQAPGK<br>GLEWVSVINTDGGTYYADSVKGRFTISRDNSKNTLYLQMNSLRAEDTAVYYCAKDWGGPE<br>PTRGQGTLVTVSSGGGGSGGGGSQVQLVESGGGVVQPGGSLRLSCAASISIFDIYAMDWY<br>RQAPGKQRELVAVSFRDGSTYYADSVKGRFTISRDNSKNTLYLQMNSLRAEDTAVYYCHV<br>SLYRDPLGVAGGIGVYWGQGTLVTVSSGGGGSGGGGSEVQLVESGGGLVQPGGSLRLSCA<br>ASGRTLSIYSMGWFRQAPGKEREFVATIGWNSGRTFYPDSVKGRFTISRDNSKNTLYLQM<br>NSLRAEDTAVYYCAAAKGPLRLSSQADYWGQGTLVTVSSDKTHTCPPCPAPELLGGPSVF<br>LFPPKPKDTLMISRTPEVTCVVVDVSHEDPEVKFNWYVDGVEVHNAKTKPREEQYNSTYR<br>VVSVLTVLHQDWLNGKEYKCKVSNKALPAPIEKTISKAKGWPREPQVYTLPPSREEMTKN<br>QVSLTCLVKGFYPSDIAVEWESNGQPENNYKTTPPVLDSDGSFFLYSKLTVDKSRWQQGN<br>VFSCSVMHEALHNHYTQKSLSLSPGK | SEQ ID NO: 298 |
| FM1B6<br>7.1 | QVQLVESGGGVVWPGGSLRLSCAASISIFDIYAMDWYRQAPGKQRELVAVSFRDGSTYYA<br>DSVKGRFTISRDNSKNTLYLQMNSLRAEDTAVYYCHVSLYRDPLGVAGGIGVYWGQGTLV<br>TVSSGGGGSGGGGSEVQLLESGGGLVWPGGSLRLSCAASGRTYAMGWFRQAPGKEREFVA<br>AINALGTRTYYADSVKGRFTISRDNSKNTLYLQMNSLRAEDTAVYYCTAQGQWRAAPVAV<br>AAEYEFWGQGTLVTVSSDKTHTCPPCPAPELLGGPSVFLFPPKPKDTLMISRTPEVTCVV<br>VDVSHEDPEVKFNWYVDGVEVHNAKTKPREEQYNSTYRVVSVLTVLHQDWLNGKEYKCKV<br>SNKALPAPIEKTISKAKGWPREPQVYTLPPSREEMTKNQVSLTCLVKGFYPSDIAVEWES<br>NGQPENNYKTTPPVLDSDGSFFLYSRLTVDKSRWQQGNVFSCSVMHEALHNHYTQKSLSL<br>SPGK | SEQ ID NO: 299 |
| | EVQLVESGGGLVQPGGSLRLSCAASGFTFSTSWMYWLRQAPGKGLEWVSVINTDGGTYYA<br>DSVKGRFTISRDNSKNTLYLQMNSLRAEDTAVYYCAKDWGGPEPTRGQGTLVTVSSGGGG<br>SGGGGSEVQLLESGGGLVQPGGSLRLSCAASGFTLENKAIGWFRQAPGKEREGVLCISKS<br>GSWTYYADSVKGRFTISRDNSKNTVYLQMNSLRPEDTAVYYCATTTAGGGLCWDGTTFSR<br>LASSWGQGTLVTVSSDKTHTCPPCPAPELLGGPSVFLFPPKPKDTLMISRTPEVTCVVVD<br>VSHEDPEVKFNWYVDGVEVHNAKTKPREEQYNSTYRVVSVLTVLHQDWLNGKEYKCKVSN<br>KALPAPIEKTISKAKGWPREPQVYTLPPSREEMTKNQVSLTCLVKGFYPSDIAVEWESNG<br>QPENNYKTTPPVLDSDGSFLLYSKLTVDKSRWQQGNVFSCSVMHEALHNHYTQKSLSLSP<br>GK | SEQ ID NO: 300 |
| FM1B6<br>8.1 | QVQLVESGGGVVWPGGSLRLSCAASISIFDIYAMDWYRQAPGKQRELVAVSFRDGSTYYA<br>DSVKGRFTISRDNSKNTLYLQMNSLRAEDTAVYYCHVSLYRDPLGVAGGIGVYWGQGTLV<br>TVSSGGGGSGGGGSEVQLLESGGGLVWPGGSLRLSCAASGRTYAMGWFRQAPGKEREFVA<br>AINALGTRTYYADSVKGRFTISRDNSKNTLYLQMNSLRAEDTAVYYCTAQGQWRAAPVAV<br>AAEYEFWGQGTLVTVSSDKTHTCPPCPAPELLGGPSVFLFPPKPKDTLMISRTPEVTCVV<br>VDVSHEDPEVKFNWYVDGVEVHNAKTKPREEQYNSTYRVVSVLTVLHQDWLNGKEYKCKV<br>SNKALPAPIEKTISKAKGWPREPQVYTLPPSREEMTKNQVSLTCLVKGFYPSDIAVEWES<br>NGQPENNYKTTPPVLDSDGSFFLYSRLTVDKSRWQQGNVFSCSVMHEALHNHYTQKSLSL<br>SPGK | SEQ ID NO: 301 |
| | EVQLLESGGGLVQPGGSLRLSCAASGFTLENKAIGWFRQAPGKEREGVLCISKSGSWTYY<br>ADSVKGRFTISRDNSKNTVYLQMNSLRPEDTAVYYCATTTAGGGLCWDGTTFSRLASSWG<br>QGTLVTVSSGGGGSGGGGSEVQLVESGGGLVQPGGSLRLSCAASGFTFSTSWMYWLRQAP<br>GKGLEWVSVINTDGGTYYADSVKGRFTISRDNSKNTLYLQMNSLRAEDTAVYYCAKDWGG<br>PEPTRGQGTLVTVSSDKTHTCPPCPAPELLGGPSVFLFPPKPKDTLMISRTPEVTCVVVD<br>VSHEDPEVKFNWYVDGVEVHNAKTKPREEQYNSTYRVVSVLTVLHQDWLNGKEYKCKVSN<br>KALPAPIEKTISKAKGWPREPQVYTLPPSREEMTKNQVSLTCLVKGFYPSDIAVEWESNG<br>QPENNYKTTPPVLDSDGSFLLYSKLTVDKSRWQQGNVFSCSVMHEALHNHYTQKSLSLSP<br>GK | SEQ ID NO: 302 |
| FM1B6<br>9.1 | QVQLVESGGGVVWPGGSLRLSCAASISIFDIYAMDWYRQAPGKQRELVAVSFRDGSTYYA<br>DSVKGRFTISRDNSKNTLYLQMNSLRAEDTAVYYCHVSLYRDPLGVAGGIGVYWGQGTLV<br>TVSSGGGGSGGGGSEVQLLESGGGLVWPGGSLRLSCAASGRTYAMGWFRQAPGKEREFVA<br>AINALGTRTYYADSVKGRFTISRDNSKNTLYLQMNSLRAEDTAVYYCTAQGQWRAAPVAV<br>AAEYEFWGQGTLVTVSSDKTHTCPPCPAPELLGGPSVFLFPPKPKDTLMISRTPEVTCVV<br>VDVSHEDPEVKFNWYVDGVEVHNAKTKPREEQYNSTYRVVSVLTVLHQDWLNGKEYKCKV<br>SNKALPAPIEKTISKAKGWPREPQVYTLPPSREEMTKNQVSLTCLVKGFYPSDIAVEWES<br>NGQPENNYKTTPPVLDSDGSFFLYSRLTVDKSRWQQGNVFSCSVMHEALHNHYTQKSLSL<br>SPGK | SEQ ID NO: 303 |
| | EVQLVESGGGLVWPGGSLRLSCAISGLSLDTYAVGWFRQAPGKEREGVSCISSGHGMTYY<br>ADSVKGRFTISTDNSKNTVYLQMNSLRAEDTAVYYCATESRYYCSDNWPAPQRYIYWGQG<br>TLVTVSSGGGGSGGGGSEVQLVESGGGLVQPGGSLRLSCAASGFTFSTSWMYWLRQAPGK<br>GLEWVSVINTDGGTYYADSVKGRFTISRDNSKNTLYLQMNSLRAEDTAVYYCAKDWGGPE<br>PTRGQGTLVTVSSDKTHTCPPCPAPELLGGPSVFLFPPKPKDTLMISRTPEVTCVVVDVS<br>HEDPEVKFNWYVDGVEVHNAKTKPREEQYNSTYRVVSVLTVLHQDWLNGKEYKCKVSNKA<br>LPAPIEKTISKAKGWPREPQVYTLPPSREEMTKNQVSLTCLVKGFYPSDIAVEWESNGWP<br>ENNYKTTPPVLDSDGSFLLYSKLTVDKSRWQQGNVFSCSVMHEALHNHYTQKSLSLSPGK | SEQ ID NO: 305 |
| FM1B7<br>0.1 | QVQLVESGGGVVWPGGSLRLSCAASISIFDIYAMDWYRQAPGKQRELVAVSFRDGSTYYA<br>DSVKGRFTISRDNSKNTLYLQMNSLRAEDTAVYYCHVSLYRDPLGVAGGIGVYWGQGTLV<br>TVSSGGGGSGGGGSEVQLVESGGGLVWPGGSLRLSCAASGRTLSIYSMGWFRQAPGKERE<br>FVATIGWNSGRTFYPDSVKGRFTISRDNSKNTLYLQMNSLRAEDTAVYYCAAAKGPLRLS | SEQ ID NO: 306 |

TABLE 44-continued

Amino acid sequences of humanized sdAb multimer Fc fusion constructs

| | | |
|---|---|---|
| | SQADYWGQGTLVTVSSDKTHTCPPCPAPELLGGPSVFLFPPKPKDTLMISRTPEVTCVVV<br>DVSHEDPEVKFNWYVDGVEVHNAKTKPREEQYNSTYRVVSVLTVLHQDWLNGKEYKCKVS<br>NKALPAPIEKTISKAKGQPREPQVYTLPPSREEMTKNQVSLTCLVKGFYPSDIAVEWESN<br>GQPENNYKTTPPVLDSDGSFFLYSRLTVDKSRWQQGNVFSCSVMHEALHNHYTQKSLSLS<br>PGK | |
| | EVQLVESGGGLVQPGGSLRLSCAASGFTFSTSWMYWLRQAPGKGLEWVSVINTDGGTYYA<br>DSVKGRFTISRDNSKNTLYLQMNSLRAEDTAVYYCAKDWGGPEPTRGQGTLVTVSSGGGG<br>SGGGGSEVQLLESGGGLVQPGGSLRLSCAASGFTLENKAIGWFRQAPGKEREGVLCISKS<br>GSWTYYADSVKGRFTISRDNSKNTVYLQMNSLRPEDTAVYYCATTTAGGGLCWDGTTFSR<br>LASSWGQGTLVTVSSDKTHTCPPCPAPELLGGPSVFLFPPKPKDTLMISRTPEVTCVVVD<br>VSHEDPEVKFNWYVDGVEVHNAKTKPREEQYNSTYRVVSVLTVLHQDWLNGKEYKCKVSN<br>KALPAPIEKTISKAKGWPREPQVYTLPPSREEMTKNQVSLTCLVKGFYPSDIAVEWESNG<br>QPENNYKTTPPVLDSDGSFLLYSKLTVDKSRWQQGNVFSCSVMHEALHNHYTQKSLSLSP<br>GK | SEQ ID NO: 307 |
| FM1B7<br>1.1 | QVQLVESGGGVVWPGGSLRLSCAASISIFDIYAMDWYRQAPGKQRELVAVSFRDGSTYYA<br>DSVKGRFTISRDNSKNTLYLQMNSLRAEDTAVYYCHVSLYRDPLGVAGGIGVYWGQGTLV<br>TVSSGGGGSGGGGSEVQLVESGGGLVWPGGSLRLSCAASGRTLSIYSMGWFRQAPGKERE<br>FVATIGWNSGRTFYPDSVKGRFTISRDNSKNTLYLQMNSLRAEDTAVYYCAAAKGPLRLS<br>SQADYWGQGTLVTVSSDKTHTCPPCPAPELLGGPSVFLFPPKPKDTLMISRTPEVTCVVV<br>DVSHEDPEVKFNWYVDGVEVHNAKTKPREEQYNSTYRVVSVLTVLHQDWLNGKEYKCKVS<br>NKALPAPIEKTISKAKGQPREPQVYTLPPSREEMTKNQVSLTCLVKGFYPSDIAVEWESN<br>GQPENNYKTTPPVLDSDGSFFLYSRLTVDKSRWQQGNVFSCSVMHEALHNHYTQKSLSLS<br>PGK | SEQ ID NO: 308 |
| | EVQLLESGGGLVQPGGSLRLSCAASGFTLENKAIGWFRQAPGKEREGVLCISKSGSWTYY<br>ADSVKGRFTISRDNSKNTVYLQMNSLRPEDTAVYYCATTTAGGGLCWDGTTFSRLASSWG<br>QGTLVTVSSGGGGSGGGGSEVQLVESGGGLVQPGGSLRLSCAASGFTFSTSWMYWLRQAP<br>GKGLEWVSVINTDGGTYYADSVKGRFTISRDNSKNTLYLQMNSLRAEDTAVYYCAKDWGG<br>PEPTRGQGTLVTVSSDKTHTCPPCPAPELLGGPSVFLFPPKPKDTLMISRTPEVTCVVVD<br>VSHEDPEVKFNWYVDGVEVHNAKTKPREEQYNSTYRVVSVLTVLHQDWLNGKEYKCKVSN<br>KALPAPIEKTISKAKGWPREPQVYTLPPSREEMTKNQVSLTCLVKGFYPSDIAVEWESNG<br>QPENNYKTTPPVLDSDGSFLLYSKLTVDKSRWQQGNVFSCSVMHEALHNHYTQKSLSLSP<br>GK | SEQ ID NO: 309 |
| FM1B7<br>2.1 | QVQLVESGGGVVWPGGSLRLSCAASISIFDIYAMDWYRQAPGKQRELVAVSFRDGSTYYA<br>DSVKGRFTISRDNSKNTLYLQMNSLRAEDTAVYYCHVSLYRDPLGVAGGIGVYWGQGTLV<br>TVSSGGGGSGGGGSEVQLVESGGGLVWPGGSLRLSCAASGRTLSIYSMGWFRQAPGKERE<br>FVATIGWNSGRTFYPDSVKGRFTISRDNSKNTLYLQMNSLRAEDTAVYYCAAAKGPLRLS<br>SQADYWGQGTLVTVSSDKTHTCPPCPAPELLGGPSVFLFPPKPKDTLMISRTPEVTCVVV<br>DVSHEDPEVKFNWYVDGVEVHNAKTKPREEQYNSTYRVVSVLTVLHQDWLNGKEYKCKVS<br>NKALPAPIEKTISKAKGQPREPQVYTLPPSREEMTKNQVSLTCLVKGFYPSDIAVEWESN<br>GQPENNYKTTPPVLDSDGSFFLYSRLTVDKSRWQQGNVFSCSVMHEALHNHYTQKSLSLS<br>PGK | SEQ ID NO: 310 |
| | EVQLVESGGGLVWPGGSLRLSCAISGLSLDTYAVGWFRQAPGKEREGVSCISSGHGMTYY<br>ADSVKGRFTISTDNSKNTVYLQMNSLRAEDTAVYYCATESRYYCSDNWPAPQRYIYWGQG<br>TLVTVSSGGGGSGGGGSEVQLVESGGGLVQPGGSLRLSCAASGFTFSTSWMYWLRQAPGK<br>GLEWVSVINTDGGTYYADSVKGRFTISRDNSKNTLYLQMNSLRAEDTAVYYCAKDWGGPE<br>PTRGQGTLVTVSSDKTHTCPPCPAPELLGGPSVFLFPPKPKDTLMISRTPEVTCVVVDVS<br>HEDPEVKFNWYVDGVEVHNAKTKPREEQYNSTYRVVSVLTVLHQDWLNGKEYKCKVSNKA<br>LPAPIEKTISKAKGWPREPQVYTLPPSREEMTKNQVSLTCLVKGFYPSDIAVEWESNGWP<br>ENNYKTTPPVLDSDGSFLLYSKLTVDKSRWQQGNVFSCSVMHEALHNHYTQKSLSLSPGK | SEQ ID NO: 311 |
| FM1B7<br>3.1 | EVQLLESGGGLVQPGGSLRLSCAASGRTYAMGWFRQAPGKEREFVAAINALGTRTYYADS<br>VKGRFTISRDNSKNTLYLQMNSLRAEDTAVYYCTAQGQWRAAPVAVAAEYEFWGQGTLVT<br>VSSGGGGSGGGGSQVQLVESGGGVVWPGGSLRLSCAASISIFDIYAMDWYRQAPGKQREL<br>VAVSFRDGSTYYADSVKGRFTISRDNSKNTLYLQMNSLRAEDTAVYYCHVSLYRDPLGVA<br>GGIGVYWGQGTLVTVSSDKTHTCPPCPAPELLGGPSVFLFPPKPKDTLMISRTPEVTCVV<br>VDVSHEDPEVKFNWYVDGVEVHNAKTKPREEQYNSTYRVVSVLTVLHQDWLNGKEYKCKV<br>SNKALPAPIEKTISKAKGWPREPQVYTLPPSREEMTKNQVSLTCLVKGFYPSDIAVEWES<br>NGQPENNYKTTPPVLDSDGSFFLYSRLTVDKSRWQQGNVFSCSVMHEALHNHYTQKSLSL<br>SPGK | SEQ ID NO: 312 |
| | EVQLVESGGGLVQPGGSLRLSCAASGFTFSTSWMYWLRQAPGKGLEWVSVINTDGGTYYA<br>DSVKGRFTISRDNSKNTLYLQMNSLRAEDTAVYYCAKDWGGPEPTRGQGTLVTVSSGGGG<br>SGGGGSEVQLLESGGGLVQPGGSLRLSCAASGFTLENKAIGWFRQAPGKEREGVLCISKS<br>GSWTYYADSVKGRFTISRDNSKNTVYLQMNSLRPEDTAVYYCATTTAGGGLCWDGTTFSR<br>LASSWGQGTLVTVSSDKTHTCPPCPAPELLGGPSVFLFPPKPKDTLMISRTPEVTCVVVD<br>VSHEDPEVKFNWYVDGVEVHNAKTKPREEQYNSTYRVVSVLTVLHQDWLNGKEYKCKVSN<br>KALPAPIEKTISKAKGWPREPQVYTLPPSREEMTKNQVSLTCLVKGFYPSDIAVEWESNG<br>QPENNYKTTPPVLDSDGSFLLYSKLTVDKSRWQQGNVFSCSVMHEALHNHYTQKSLSLSP<br>GK | SEQ ID NO: 313 |
| FM1B7<br>4.1 | EVQLLESGGGLVQPGGSLRLSCAASGRTYAMGWFRQAPGKEREFVAAINALGTRTYYADS<br>VKGRFTISRDNSKNTLYLQMNSLRAEDTAVYYCTAQGQWRAAPVAVAAEYEFWGQGTLVT<br>VSSGGGGSGGGGSQVQLVESGGGVVWPGGSLRLSCAASISIFDIYAMDWYRQAPGKQREL | SEQ ID NO: 314 |

TABLE 44-continued

Amino acid sequences of humanized sdAb multimer Fc fusion constructs

| | | |
|---|---|---|
| | VAVSFRDGSTYYADSVKGRFTISRDNSKNTLYLQMNSLRAEDTAVYYCHVSLYRDPLGVA GGIGVYWGQGTLVTVSSDKTHTCPPCPAPELLGGPSVFLFPPKPKDTLMISRTPEVTCVV VDVSHEDPEVKFNWYVDGVEVHNAKTKPREEQYNSTYRVVSVLTVLHQDWLNGKEYKCKV SNKALPAPIEKTISKAKGWPREPQVYTLPPSREEMTKNQVSLTCLVKGFYPSDIAVEWES NGQPENNYKTTPPVLDSDGSFFLYSRLTVDKSRWQQGNVFSCSVMHEALHNHYTQKSLSL SPGK | |
| | EVQLLESGGGLVQPGGSLRLSCAASGFTLENKAIGWFRQAPGKEREGVLCISKSGSWTYY ADSVKGRFTISRDNSKNTVYLQMNSLRPEDTAVYYCATTTAGGGLCWDGTTFSRLASSWG QGTLVTVSSGGGGSGGGGSEVQLVESGGGLVQPGGSLRLSCAASGFTFSTSWMYWLRQAP GKGLEWVSVINTDGGTYYADSVKGRFTISRDNSKNTLYLQMNSLRAEDTAVYYCAKDWGG PEPTRGQGTLVTVSSDKTHTCPPCPAPELLGGPSVFLFPPKPKDTLMISRTPEVTCVVVD VSHEDPEVKFNWYVDGVEVHNAKTKPREEQYNSTYRVVSVLTVLHQDWLNGKEYKCKVSN KALPAPIEKTISKAKGWPREPQVYTLPPSREEMTKNQVSLTCLVKGFYPSDIAVEWESNG QPENNYKTTPPVLDSDGSFLLYSKLTVDKSRWQQGNVFSCSVMHEALHNHYTQKSLSLSP GK | SEQ ID NO: 315 |
| FM1B7 5.1 | EVQLLESGGGLVQPGGSLRLSCAASGRTYAMGWFRQAPGKEREFVAAINALGTRTYYADS VKGRFTISRDNSKNTLYLQMNSLRAEDTAVYYCTAQGQWRAAPVAVAAEYEFWGQGTLVT VSSGGGGSGGGGSQVQLVESGGGVVQPGGSLRLSCAASISIFDIYAMDWYRQAPGKQREL VAVSFRDGSTYYADSVKGRFTISRDNSKNTLYLQMNSLRAEDTAVYYCHVSLYRDPLGVA GGIGVYWGQGTLVTVSSDKTHTCPPCPAPELLGGPSVFLFPPKPKDTLMISRTPEVTCVV VDVSHEDPEVKFNWYVDGVEVHNAKTKPREEQYNSTYRVVSVLTVLHQDWLNGKEYKCKV SNKALPAPIEKTISKAKGWPREPQVYTLPPSREEMTKNQVSLTCLVKGFYPSDIAVEWES NGQPENNYKTTPPVLDSDGSFFLYSRLTVDKSRWQQGNVFSCSVMHEALHNHYTQKSLSL SPGK | SEQ ID NO: 316 |
| | EVQLVESGGGLVWPGGSLRLSCAISGLSLDTYAVGWFRQAPGKEREGVSCISSGHGMTYY ADSVKGRFTISTDNSKNTVYLQMNSLRAEDTAVYYCATESRYYCSDNWPAPQRYIYWGQG TLVTVSSGGGGSGGGGSEVQLVESGGGLVQPGGSLRLSCAASGFTFSTSWMYWLRQAPGK GLEWVSVINTDGGTYYADSVKGRFTISRDNSKNTLYLQMNSLRAEDTAVYYCAKDWGGPE PTRGQGTLVTVSSDKTHTCPPCPAPELLGGPSVFLFPPKPKDTLMISRTPEVTCVVVDVS HEDPEVKFNWYVDGVEVHNAKTKPREEQYNSTYRVVSVLTVLHQDWLNGKEYKCKVSNKA LPAPIEKTISKAKGWPREPQVYTLPPSREEMTKNQVSLTCLVKGFYPSDIAVEWESNGWP ENNYKTTPPVLDSDGSFLLYSKLTVDKSRWQQGNVFSCSVMHEALHNHYTQKSLSLSPGK | SEQ ID NO: 317 |
| FM1B7 6.1 | QVQLVESGGGVVWPGGSLRLSCAASISIFDIYAMDWYRQAPGKQRELVAVSFRDGSTYYA DSVKGRFTISRDNSKNTLYLQMNSLRAEDTAVYYCHVSLYRDPLGVAGGIGVYWGQGTLV TVSSGGGGSGGGGSEVQLLESGGGLVWPGGSLRLSCAASGRTYAMGWFRQAPGKEREFVA AINALGTRTYYADSVKGRFTISRDNSKNTLYLQMNSLRAEDTAVYYCTAQGQWRAAPVAV AAEYEFWGQGTLVTVSSGGGGSGGGGSEVQLLESGGGLVQPGGSLRLSCAASGFTLENKA IGWFRQAPGKEREGVLCISKSGSWTYYADSVKGRFTISRDNSKNTVYLQMNSLRPEDTAV YYCATTTAGGGLCWDGTTFSRLASSWGQGTLVTVSSGGGGSGGGGSEVQLVESGGGLVQP GGSLRLSCAASGFTFSTSWMYWLRQAPGKGLEWVSVINTDGGTYYADSVKGRFTISRDNS KNTLYLQMNSLRAEDTAVYYCAKDWGGPEPTRGQGTLVTVSSDKTHTCPPCPAPELLGGP SVFLFPPKPKDTLMISRTPEVTCVVVDVSHEDPEVKFNWYVDGVEVHNAKTKPREEQYNS TYRVVSVLTVLHQDWLNGKEYKCKVSNKALPAPIEKTISKAKGQPREPQVYTLPPSREEM TKNQVSLTCLVKGFYPSDIAVEWESNGQPENNYKTTPPVLDSDGSFFLYSRLTVDKSRWQ WGNVFSCSVMHEALHNHYTQKSLSLSPGK | SEQ ID NO: 318 |
| | DKTHTCPPCPAPELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKALPAPIEKTISKAK GQPREPQVYTLPPSREEMTKNQVSLTCLVKGFYPSDIAVEWESNGQPENNYKTTPPVLDS DGSFLLYSKLTVDKSRWQQGNVFSCSVMHEALHNHYTQKSLSLSPGK | SEQ ID NO: 319 |
| FM1B6 7.2 | QVQLVESGGGVVWPGGSLRLSCAASISIFDIYAMDWYRQAPGKQRELVAVSFRDGSTYYA DSVKGRFTISRDNSKNTLYLQMNSLRAEDTAVYYCHVSLYRDPLGVAGGIGVYWGQGTLV TVSSGGGGSGGGGSEVQLLESGGGLVWPGGSLRLSCAASGRTYAMGWFRQAPGKEREFVA AINALGTRTYYADSVKGRFTISRDNSKNTLYLQMNSLRAEDTAVYYCTAQGQWRAAPVAV AAEYEFWGQGTLVTVSSDKTHTCPPCPAPELLGGPSVFLFPPKPKDTLMISRTPEVTCVV VDVSHEDPEVKFNWYVDGVEVHNAKTKPREEQYNSTYRVVSVLTVLHQDWLNGKEYKCKV SNKALPAPIEKTISKAKGWPREPQVYTLPPSREEMTKNQVSLWCLVKGFYPSDIAVEWES NGQPENNYKTTPPVLDSDGSFFLYSKLTVDKSRWQQGNVFSCSVMHEALHNHYTQKSLSL SPGK | SEQ ID NO: 320 |
| | EVQLVESGGGLVQPGGSLRLSCAASGFTFSTSWMYWLRQAPGKGLEWVSVINTDGGTYYA DSVKGRFTISRDNSKNTLYLQMNSLRAEDTAVYYCAKDWGGPEPTRGQGTLVTVSSGGGG SGGGGSEVQLLESGGGLVQPGGSLRLSCAASGFTLENKAIGWFRQAPGKEREGVLCISKS GSWTYYADSVKGRFTISRDNSKNTVYLQMNSLRPEDTAVYYCATTTAGGGLCWDGTTFSR LASSWGQGTLVTVSSDKTHTCPPCPAPELLGGPSVFLFPPKPKDTLMISRTPEVTCVVVD VSHEDPEVKFNWYVDGVEVHNAKTKPREEQYNSTYRVVSVLTVLHQDWLNGKEYKCKVSN KALPAPIEKTISKAKGWPREPQVYTLPPSREEMTKNQVSLSCAVKGFYPSDIAVEWESNG QPENNYKTTPPVLDSDGSFFLVSKLTVDKSRWQQGNVFSCSVMHEALHNHYTQKSLSLSP GK | SEQ ID NO: 321 |
| FM1B6 8.2 | QVQLVESGGGVVWPGGSLRLSCAASISIFDIYAMDWYRQAPGKQRELVAVSFRDGSTYYA DSVKGRFTISRDNSKNTLYLQMNSLRAEDTAVYYCHVSLYRDPLGVAGGIGVYWGQGTLV TVSSGGGGSGGGGSEVQLLESGGGLVWPGGSLRLSCAASGRTYAMGWFRQAPGKEREFVA | SEQ ID NO: 322 |

TABLE 44-continued

Amino acid sequences of humanized sdAb multimer Fc fusion constructs

| | | |
|---|---|---|
| | AINALGTRTYYADSVKGRFTISRDNSKNTLYLQMNSLRAEDTAVYYCTAQGQWRAAPVAV<br>AAEYEFWGQGTLVTVSSDKTHTCPPCPAPELLGGPSVFLFPPKPKDTLMISRTPEVTCVV<br>VDVSHEDPEVKFNWYVDGVEVHNAKTKPREEQYNSTYRVVSVLTVLHQDWLNGKEYKCKV<br>SNKALPAPIEKTISKAKGWPREPQVYTLPPSREEMTKNQVSLWCLVKGFYPSDIAVEWES<br>NGQPENNYKTTPPVLDSDGSFFLYSKLTVDKSRWQQGNVFSCSVMHEALHNHYTQKSLSL<br>SPGK | |
| | EVQLLESGGGLVQPGGSLRLSCAASGFTLENKAIGWFRQAPGKEREGVLCISKSGSWTYY<br>ADSVKGRFTISRDNSKNTVYLQMNSLRPEDTAVYYCATTTAGGGLCWDGTTFSRLASSWG<br>QGTLVTVSSGGGGSGGGGSEVQLVESGGGLVQPGGSLRLSCAASGFTFSTSWMYWLRQAP<br>GKGLEWVSVINTDGGTYYADSVKGRFTISRDNSKNTLYLQMNSLRAEDTAVYYCAKDWGG<br>PEPTRGQGTLVTVSSDKTHTCPPCPAPELLGGPSVFLFPPKPKDTLMISRTPEVTCVVVD<br>VSHEDPEVKFNWYVDGVEVHNAKTKPREEQYNSTYRVVSVLTVLHQDWLNGKEYKCKVSN<br>KALPAPIEKTISKAKGWPREPQVYTLPPSREEMTKNQVSLSCAVKGFYPSDIAVEWESNG<br>QPENNYKTTPPVLDSDGSFFLVSKLTVDKSRWQQGNVFSCSVMHEALHNHYTQKSLSLSP<br>GK | SEQ ID NO: 323 |
| FM1B6<br>9.2 | QVQLVESGGGVVWPGGSLRLSCAASISIFDIYAMDWYRQAPGKQRELVAVSFRDGSTYYA<br>DSVKGRFTISRDNSKNTLYLQMNSLRAEDTAVYYCHVSLYRDPLGVAGGIGVYWGQGTLV<br>TVSSGGGGSGGGGSEVQLLESGGGLVWPGGSLRLSCAASGRTYAMGWFRQAPGKEREFVA<br>AINALGTRTYYADSVKGRFTISRDNSKNTLYLQMNSLRAEDTAVYYCTAQGQWRAAPVAV<br>AAEYEFWGQGTLVTVSSDKTHTCPPCPAPELLGGPSVFLFPPKPKDTLMISRTPEVTCVV<br>VDVSHEDPEVKFNWYVDGVEVHNAKTKPREEQYNSTYRVVSVLTVLHQDWLNGKEYKCKV<br>SNKALPAPIEKTISKAKGWPREPQVYTLPPSREEMTKNQVSLWCLVKGFYPSDIAVEWES<br>NGQPENNYKTTPPVLDSDGSFFLYSKLTVDKSRWQQGNVFSCSVMHEALHNHYTQKSLSL<br>SPGK | SEQ ID NO: 324 |
| | EVQLVESGGGLVWPGGSLRLSCAISGLSLDTYAVGWFRQAPGKEREGVSCISSGHGMTYY<br>ADSVKGRFTISTDNSKNTVYLQMNSLRAEDTAVYYCATESRYYCSDNWPAPQRYIYWGQG<br>TLVTVSSGGGGSGGGGSEVQLVESGGGLVQPGGSLRLSCAASGFTFSTSWMYWLRQAPGK<br>GLEWVSVINTDGGTYYADSVKGRFTISRDNSKNTLYLQMNSLRAEDTAVYYCAKDWGGPE<br>PTRGQGTLVTVSSDKTHTCPPCPAPELLGGPSVFLFPPKPKDTLMISRTPEVTCVVVDVS<br>HEDPEVKFNWYVDGVEVHNAKTKPREEQYNSTYRVVSVLTVLHQDWLNGKEYKCKVSNKA<br>LPAPIEKTISKAKGWPREPQVYTLPPSREEMTKNQVSLSCAVKGFYPSDIAVEWESNGWP<br>ENNYKTTPPVLDSDGSFFLVSKLTVDKSRWQQGNVFSCSVMHEALHNHYTQKSLSLSPGK | SEQ ID NO: 325 |
| FM1B7<br>0.2 | QVQLVESGGGVVWPGGSLRLSCAASISIFDIYAMDWYRQAPGKQRELVAVSFRDGSTYYA<br>DSVKGRFTISRDNSKNTLYLQMNSLRAEDTAVYYCHVSLYRDPLGVAGGIGVYWGQGTLV<br>TVSSGGGGSGGGGSEVQLVESGGGLVWPGGSLRLSCAASGRTLSIYSMGWFRQAPGKERE<br>FVATIGWNSGRTFYPDSVKGRFTISRDNSKNTLYLQMNSLRAEDTAVYYCAAAKGPLRLS<br>SQADYWGQGTLVTVSSDKTHTCPPCPAPELLGGPSVFLFPPKPKDTLMISRTPEVTCVVV<br>DVSHEDPEVKFNWYVDGVEVHNAKTKPREEQYNSTYRVVSVLTVLHQDWLNGKEYKCKVS<br>NKALPAPIEKTISKAKGQPREPQVYTLPPSREEMTKNQVSLWCLVKGFYPSDIAVEWESN<br>GQPENNYKTTPPVLDSDGSFFLYSKLTVDKSRWQQGNVFSCSVMHEALHNHYTQKSLSLS<br>PGK | SEQ ID NO: 326 |
| | EVQLVESGGGLVQPGGSLRLSCAASGFTFSTSWMYWLRQAPGKGLEWVSVINTDGGTYYA<br>DSVKGRFTISRDNSKNTLYLQMNSLRAEDTAVYYCAKDWGGPEPTRGQGTLVTVSSGGGG<br>SGGGGSEVQLLESGGGLVQPGGSLRLSCAASGFTLENKAIGWFRQAPGKEREGVLCISKS<br>GSWTYYADSVKGRFTISRDNSKNTVYLQMNSLRPEDTAVYYCATTTAGGGLCWDGTTFSR<br>LASSWGQGTLVTVSSDKTHTCPPCPAPELLGGPSVFLFPPKPKDTLMISRTPEVTCVVVD<br>VSHEDPEVKFNWYVDGVEVHNAKTKPREEQYNSTYRVVSVLTVLHQDWLNGKEYKCKVSN<br>KALPAPIEKTISKAKGWPREPQVYTLPPSREEMTKNQVSLSCAVKGFYPSDIAVEWESNG<br>QPENNYKTTPPVLDSDGSFFLYSKLTVDKSRWQQGNVFSCSVMHEALHNHYTQKSLSLSP<br>GK | SEQ ID NO: 327 |
| FM1B7<br>1.2 | QVQLVESGGGVVWPGGSLRLSCAASISIFDIYAMDWYRQAPGKQRELVAVSFRDGSTYYA<br>DSVKGRFTISRDNSKNTLYLQMNSLRAEDTAVYYCHVSLYRDPLGVAGGIGVYWGQGTLV<br>TVSSGGGGSGGGGSEVQLVESGGGLVWPGGSLRLSCAASGRTLSIYSMGWFRQAPGKERE<br>FVATIGWNSGRTFYPDSVKGRFTISRDNSKNTLYLQMNSLRAEDTAVYYCAAAKGPLRLS<br>SQADYWGQGTLVTVSSDKTHTCPPCPAPELLGGPSVFLFPPKPKDTLMISRTPEVTCVVV<br>DVSHEDPEVKFNWYVDGVEVHNAKTKPREEQYNSTYRVVSVLTVLHQDWLNGKEYKCKVS<br>NKALPAPIEKTISKAKGQPREPQVYTLPPSREEMTKNQVSLWCLVKGFYPSDIAVEWESN<br>GQPENNYKTTPPVLDSDGSFFLYSKLTVDKSRWQQGNVFSCSVMHEALHNHYTQKSLSLS<br>PGK | SEQ ID NO: 328 |
| | EVQLLESGGGLVQPGGSLRLSCAASGFTLENKAIGWFRQAPGKEREGVLCISKSGSWTYY<br>ADSVKGRFTISRDNSKNTVYLQMNSLRPEDTAVYYCATTTAGGGLCWDGTTFSRLASSWG<br>QGTLVTVSSGGGGSGGGGSEVQLVESGGGLVQPGGSLRLSCAASGFTFSTSWMYWLRQAP<br>GKGLEWVSVINTDGGTYYADSVKGRFTISRDNSKNTLYLQMNSLRAEDTAVYYCAKDWGG<br>PEPTRGQGTLVTVSSDKTHTCPPCPAPELLGGPSVFLFPPKPKDTLMISRTPEVTCVVVD<br>VSHEDPEVKFNWYVDGVEVHNAKTKPREEQYNSTYRVVSVLTVLHQDWLNGKEYKCKVSN<br>KALPAPIEKTISKAKGWPREPQVYTLPPSREEMTKNQVSLSCAVKGFYPSDIAVEWESNG<br>QPENNYKTTPPVLDSDGSFFLYSKLTVDKSRWQQGNVFSCSVMHEALHNHYTQKSLSLSP<br>GK | SEQ ID NO: 329 |

TABLE 44-continued

Amino acid sequences of humanized sdAb multimer Fc fusion constructs

| FM1B7 2.2 | QVQLVESGGGVVWPGGSLRLSCAASISIFDIYAMDWYRQAPGKQRELVAVSFRDGSTYYA DSVKGRFTISRDNSKNTLYLQMNSLRAEDTAVYYCHVSLYRDPLGVAGGIGVYWGQGTLV TVSSGGGGSGGGGSEVQLVESGGGLVWPGGSLRLSCAASGRTLSIYSMGWFRQAPGKERE FVATIGWNSGRTFYPDSVKGRFTISRDNSKNTLYLQMNSLRAEDTAVYYCAAAKGPLRLS SQADYWGQGTLVTVSSDKTHTCPPCPAPELLGGPSVFLFPPKPKDTLMISRTPEVTCVVV DVSHEDPEVKFNWYVDGVEVHNAKTKPREEQYNSTYRVVSVLTVLHQDWLNGKEYKCKVS NKALPAPIEKTISKAKGQPREPQVYTLPPSREEMTKNQVSLWCLVKGFYPSDIAVEWESN GQPENNYKTTPPVLDSDGSFFLYSKLTVDKSRWQQGNVFSCSVMHEALHNHYTQKSLSLS PGK | SEQ ID NO: 330 |
| --- | --- | --- |
| | EVQLVESGGGLVWPGGSLRLSCAISGLSLDTYAVGWFRQAPGKEREGVSCISSGHGMTYY ADSVKGRFTISTDNSKNTVYLQMNSLRAEDTAVYYCATESRYYCSDNWPAPQRYIYWGQG TLVTVSSGGGGSGGGGSEVQLVESGGGLVQPGGSLRLSCAASGFTFSTSWMYWLRQAPGK GLEWVSVINTDGGTYYADSVKGRFTISRDNSKNTLYLQMNSLRAEDTAVYYCAKDWGGPE PTRGQGTLVTVSSDKTHTCPPCPAPELLGGPSVFLFPPKPKDTLMISRTPEVTCVVVDVS HEDPEVKFNWYVDGVEVHNAKTKPREEQYNSTYRVVSVLTVLHQDWLNGKEYKCKVSNKA LPAPIEKTISKAKGWPREPQVYTLPPSREEMTKNQVSLSCAVKGFYPSDIAVEWESNGWP ENNYKTTPPVLDSDGSFFLVSKLTVDKSRWQQGNVFSCSVMHEALHNHYTQKSLSLSPGK | SEQ ID NO: 331 |
| FM1B7 3.2 | EVQLLESGGGLVQPGGSLRLSCAASGRTYAMGWFRQAPGKEREFVAAINALGTRTYYADS VKGRFTISRDNSKNTLYLQMNSLRAEDTAVYYCTAQGQWRAAPVAVAAEYEFWGQGTLVT VSSGGGGSGGGGSQVQLVESGGGVVQPGGSLRLSCAASISIFDIYAMDWYRQAPGKQREL VAVSFRDGSTYYADSVKGRFTISRDNSKNTLYLQMNSLRAEDTAVYYCHVSLYRDPLGVA GGIGVYWGQGTLVTVSSDKTHTCPPCPAPELLGGPSVFLFPPKPKDTLMISRTPEVTCVV VDVSHEDPEVKFNWYVDGVEVHNAKTKPREEQYNSTYRVVSVLTVLHQDWLNGKEYKCKV SNKALPAPIEKTISKAKGWPREPQVYTLPPSREEMTKNQVSLWCLVKGFYPSDIAVEWES NGQPENNYKTTPPVLDSDGSFFLYSKLTVDKSRWQQGNVFSCSVMHEALHNHYTQKSLSL SPGK | SEQ ID NO: 332 |
| | EVQLVESGGGLVQPGGSLRLSCAASGFTFSTSWMYWLRQAPGKGLEWVSVINTDGGTYYA DSVKGRFTISRDNSKNTLYLQMNSLRAEDTAVYYCAKDWGGPEPTRGQGTLVTVSSGGGG SGGGGSEVQLLESGGGLVQPGGSLRLSCAASGFTLENKAIGWFRQAPGKEREGVLCISKS GSWTYYADSVKGRFTISRDNSKNTVYLQMNSLRPEDTAVYYCATTTAGGGLCWDGTTFSR LASSWGQGTLVTVSSDKTHTCPPCPAPELLGGPSVFLFPPKPKDTLMISRTPEVTCVVVD VSHEDPEVKFNWYVDGVEVHNAKTKPREEQYNSTYRVVSVLTVLHQDWLNGKEYKCKVSN KALPAPIEKTISKAKGWPREPQVYTLPPSREEMTKNQVSLSCAVKGFYPSDIAVEWESNG QPENNYKTTPPVLDSDGSFFLVSKLTVDKSRWQQGNVFSCSVMHEALHNHYTQKSLSLSP GK | SEQ ID NO: 333 |
| FM1B7 4.2 | EVQLLESGGGLVQPGGSLRLSCAASGRTYAMGWFRQAPGKEREFVAAINALGTRTYYADS VKGRFTISRDNSKNTLYLQMNSLRAEDTAVYYCTAQGQWRAAPVAVAAEYEFWGQGTLVT VSSGGGGSGGGGSQVQLVESGGGVVQPGGSLRLSCAASISIFDIYAMDWYRQAPGKQREL VAVSFRDGSTYYADSVKGRFTISRDNSKNTLYLQMNSLRAEDTAVYYCHVSLYRDPLGVA GGIGVYWGQGTLVTVSSDKTHTCPPCPAPELLGGPSVFLFPPKPKDTLMISRTPEVTCVV VDVSHEDPEVKFNWYVDGVEVHNAKTKPREEQYNSTYRVVSVLTVLHQDWLNGKEYKCKV SNKALPAPIEKTISKAKGWPREPQVYTLPPSREEMTKNQVSLWCLVKGFYPSDIAVEWES NGQPENNYKTTPPVLDSDGSFFLYSKLTVDKSRWQQGNVFSCSVMHEALHNHYTQKSLSL SPGKK | SEQ ID NO: 334 |
| | EVQLLESGGGLVQPGGSLRLSCAASGFTLENKAIGWFRQAPGKEREGVLCISKSGSWTYY ADSVKGRFTISRDNSKNTVYLQMNSLRPEDTAVYYCATTTAGGGLCWDGTTFSRLASSWG QGTLVTVSSGGGGSGGGGSEVQLVESGGGLVQPGGSLRLSCAASGFTFSTSWMYWLRQAP GKGLEWVSVINTDGGTYYADSVKGRFTISRDNSKNTLYLQMNSLRAEDTAVYYCAKDWGG PEPTRGQGTLVTVSSDKTHTCPPCPAPELLGGPSVFLFPPKPKDTLMISRTPEVTCVVVD VSHEDPEVKFNWYVDGVEVHNAKTKPREEQYNSTYRVVSVLTVLHQDWLNGKEYKCKVSN KALPAPIEKTISKAKGWPREPQVYTLPPSREEMTKNQVSLSCAVKGFYPSDIAVEWESNG QPENNYKTTPPVLDSDGSFFLVSKLTVDKSRWQQGNVFSCSVMHEALHNHYTQKSLSLSP GK | SEQ ID NO: 335 |
| FM1B7 5.2 | EVQLLESGGGLVQPGGSLRLSCAASGRTYAMGWFRQAPGKEREFVAAINALGTRTYYADS VKGRFTISRDNSKNTLYLQMNSLRAEDTAVYYCTAQGQWRAAPVAVAAEYEFWGQGTLVT VSSGGGGSGGGGSQVQLVESGGGVVQPGGSLRLSCAASISIFDIYAMDWYRQAPGKQREL VAVSFRDGSTYYADSVKGRFTISRDNSKNTLYLQMNSLRAEDTAVYYCHVSLYRDPLGVA GGIGVYWGQGTLVTVSSDKTHTCPPCPAPELLGGPSVFLFPPKPKDTLMISRTPEVTCVV VDVSHEDPEVKFNWYVDGVEVHNAKTKPREEQYNSTYRVVSVLTVLHQDWLNGKEYKCKV SNKALPAPIEKTISKAKGWPREPQVYTLPPSREEMTKNQVSLWCLVKGFYPSDIAVEWES NGQPENNYKTTPPVLDSDGSFFLYSKLTVDKSRWQQGNVFSCSVMHEALHNHYTQKSLSL SPGK | SEQ ID NO: 336 |
| | EVQLVESGGGLVWPGGSLRLSCAISGLSLDTYAVGWFRQAPGKEREGVSCISSGHGMTYY ADSVKGRFTISTDNSKNTVYLQMNSLRAEDTAVYYCATESRYYCSDNWPAPQRYIYWGQG TLVTVSSGGGGSGGGGSEVQLVESGGGLVQPGGSLRLSCAASGFTFSTSWMYWLRQAPGK GLEWVSVINTDGGTYYADSVKGRFTISRDNSKNTLYLQMNSLRAEDTAVYYCAKDWGGPE PTRGQGTLVTVSSDKTHTCPPCPAPELLGGPSVFLFPPKPKDTLMISRTPEVTCVVVDVS HEDPEVKFNWYVDGVEVHNAKTKPREEQYNSTYRVVSVLTVLHQDWLNGKEYKCKVSNKA LPAPIEKTISKAKGWPREPQVYTLPPSREEMTKNQVSLSCAVKGFYPSDIAVEWESNGWP ENNYKTTPPVLDSDGSFFLVSKLTVDKSRWQQGNVFSCSVMHEALHNHYTQKSLSLSPGK | SEQ ID NO: 337 |

TABLE 44-continued

Amino acid sequences of humanized sdAb multimer Fc fusion constructs

| | | |
|---|---|---|
| FM1B7 6.2 | QVQLVESGGGVVWPGGSLRLSCAASISIFDIYAMDWYRQAPGKQRELVAVSFRDGSTYYA DSVKGRFTISRDNSKNTLYLQMNSLRAEDTAVYYCHVSLYRDPLGVAGGIGVYWGQGTLV TVSSGGGGSGGGGSEVQLLESGGGLVWPGGSLRLSCAASGRTYAMGWFRQAPGKEREFVA AINALGTRTYYADSVKGRFTISRDNSKNTLYLQMNSLRAEDTAVYYCTAQGQWRAAPVAV AAEYEFWGQGTLVTVSSGGGGSGGGGSEVQLLESGGGLVQPGGSLRLSCAASGFTLENKA IGWFRQAPGKEREGVLCISKSGSWTYYADSVKGRFTISRDNSKNTVYLQMNSLRPEDTAV YYCATTTAGGGLCWDGTTFSRLASSWGQGTLVTVSSGGGGSGGGGSEVQLVESGGGLVQP GGSLRLSCAASGFTFSTSWMYWLRQAPGKGLEWVSVINTDGGTYYADSVKGRFTISRDNS KNTLYLQMNSLRAEDTAVYYCAKDWGGPEPTRGQGTLVTVSSDKTHTCPPCPAPELLGGP SVFLFPPKPKDTLMISRTPEVTCVVVDVSHEDPEVKFNWYVDGVEVHNAKTKPREEQYNS TYRVVSVLTVLHQDWLNGKEYKCKVSNKALPAPIEKTISKAKGQPREPQVYTLPPSREEM TKNQVSLWCLVKGFYPSDIAVEWESNGQPENNYKTTPPVLDSDGSFFLYSKLTVDKSRWQ WGNVFSCSVMHEALHNHYTQKSLSLSPGK | SEQ ID NO: 338 |
| | DKTHTCPPCPAPELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKALPAPIEKTISKAK GQPREPQVYTLPPSREEMTKNQVSLSCAVKGFYPSDIAVEWESNGQPENNYKTTPPVLDS DGSFFLVSKLTVDKSRWQQGNVFSCSVMHEALHNHYTQKSLSLSPGK | SEQ ID NO: 339 |

Influenza Neutralization by Humanized sdAb Multimer Fc Fusion Proteins

Purified Fc fusion proteins were tested in influenza virus neutralization assays as described in Example 6 and showed similar potency and breadth when compared to the corresponding wild-type versions. Average neutralization titers for different influenza strains are summarized in Table 45.

TABLE 45

Average neutralization titers (nM) of humanized sdAb multimer Fc fusion constructs

| | H3 A/Brisbane/ 10/07 | H7 A/NIBRG/60 (A/mallard/ Netherlands/12/00) | B/Brisbane/ 60/08 | B/Harbin/ 7/94 | H1 A/New Caledonia/ 20/99 | H5 A/Vietnam/ 1194/04 |
|---|---|---|---|---|---|---|
| FM1W3 | 16 | 8 | 16 | 8 | 6 | 10 |
| FM1W4 | 40 | 16 | 8 | 6 | 32 | 32 |
| FM1W5 | 16 | 6 | 10 | 10 | 6 | 8 |
| FM1W6 | 16 | 13 | 8 | 6 | 40 | 32 |
| FM1W7 | 10 | 8 | 16 | 6 | 5 | 13 |
| FM1W8 | 40 | 51 | 4 | 3 | 40 | 40 |
| FM1B67.1 | 16 | 16 | 4 | 6 | 6 | 16 |
| FM1B68.1 | 16 | 16 | 6 | 6 | 6 | 16 |
| FM1B69.1 | 26 | 16 | 3 | 6 | 6 | 16 |
| FM1B70.1 | 16 | 16 | 6 | 5 | 6 | 16 |
| FM1B71.1 | 32 | 16 | 6 | 6 | 16 | 26 |
| FM1B72.1 | 16 | 16 | 3 | 6 | 10 | 16 |
| FM1B73.1 | 16 | 16 | 5 | 6 | 101 | 101 |
| FM1B74.1 | 20 | 16 | 6 | 6 | 80 | 101 |
| FM1B75.1 | 16 | 16 | 3 | 5 | 80 | 101 |
| FM1B76.1 | 16 | 16 | 16 | 16 | 13 | 20 |

REFERENCES

Adam et al., Clinical and Vaccine Immunology, 2014; 21(11): 1528-1533.
Brandenburg et al., PLoS One, 2013; 8(12):e80034.
Corti et al., Science, 2011; 333:850-856.
Dreyfus et al., Science, 2012; 337:1343-1348.
Ekiert et al., Science, 2009; 324:246-251.
Ekiert et al., Science, 2011; 333:843-850.
Ekiert et al. Nature, 2012; 489:526-532.
Hessell et al. Nature, 2007; 449:101-104.
Hufton et al., PLoS One, 2014; 9(8):e103294.
Hultberg et al., PLoS One, 2011; 6(4):e17665.
Johnson et al., Nat Med, 2009; 15(8):901-906.
Kashyap et al., PLoS Pathog., 2010; 6:e1000990.
Klein et al., mAbs, 2012; 4(6):653-663
Krause et al., J Virol., 2012; 86:6334-6340.
Kuo et al., mAbs, 2011; 3(5):422-430.
Labrijn et al. PNAS, 2013; 110(13):5145-50.
Lee et al., Proc Natl Acad Sci USA, 2012; 109:17040-17045.
Limberis et al., Sci Transl Med., 2013; 5(187): 1-8.
Strohl, Current Opinion in Biotechnology, 2009; 20:685-691.
Sui et al., Nat Struct Mol Biol., 2009; 16:265-273.
Suscovich and Alter, Expert Rev Vaccines, 2015; 14(2): 205-219.
Tan et al., J Virol., 2012; 86:6179-6188.
Throsby et al., PLoS One, 2008; 3:e3942.
Tillib et al., Antiviral Res., 2013; 97(3):245-54.
Tsibane et al., PLoS Pathog., 2012; 8:e1003067.
Vanlandschoot et al., Antiviral Research, 2011; 92(3), 389-407.
Wang et al., PLoS Pathog., 2010b; 6:e1000796.
Xu et al., Science, 2010; 328(5976):357-60.
Yoshida et al., PLoS Pathog., 2009; 5:e1000350.

SEQUENCE LISTING (418 sequences)

SEQ ID NO: 1 - protein, 123 aa, Artificial Sequence
  SD1018
EVQLVESGGGLVQAGGSLRLSCAASGQTYHMGWFRQTPGNERESVAAVTWSGAVTRYADSVKGRFTISRDNAKNTVYLQMNSLVPEDTAIYYCAATRSMAPIIQLSPGSYDYWGPGTQVTVSS

SEQ ID NO: 2 - protein, 124 aa, Artificial Sequence
  SD1071
EVQLVESGGGLVQTGESLRLSCAFSGFTYSTYWMYWVRQGPEKGLKWVSSTNAAGTVTYYAANVRDRFTASKDNAKNTLYLQMNRLKPEDTGLYYCASKDGLIVAATLDDYDYRGQGTQVTVSS

SEQ ID NO: 3 - protein, 122 aa, Artificial Sequence
  SD1035
EVQLVESGGGLVQAGGTLRLSCAASGSAVSISRMAWYRQAPGKQRELVADIFSGGGTNYADSVKGRFTISRDNAKNTVDLQMNSLKPEDTAVYYCSARSAVAAIHWDQYDYWGQGTQVTVSS

SEQ ID NO: 4 - protein, 120 aa, Artificial Sequence
  SD1016
EVQLVESGGGLVQAGGSLRLSCVASGMFFGIAAMGWYRQAPGKQRELVANITSDFSTNYADSVKDRFTISRDNAENTVYLQMNSLKPEDTAVYYCAADSLGTGWRHYYYWGQGTQVTVSS

SEQ ID NO: 5 - protein, 122 aa, Artificial Sequence
  SD1072
EVQLVESGGGLVEAGGSLRLSCAVSGRTFSMYATGWFRQAPGKEREFVAAINSSGDKTTYADSVEGRFTISRDIGTVYLQMNNLNPEDTAVYYCAAARTLAVVTIPGGYEYWGQGTQVTVSS

SEQ ID NO: 6 - protein, 120 aa, Artificial Sequence
  SD1074
EVQLVESGGGLVQAGGSLRLSCAASRNFDAIGAMGWYRQAPGKQRELVAEITSDGSTNYTDSVKGRFTISRDNALRTMYLQMNALEPEDTAVYYCKADISIYGLTNFPYWGQGTQVTVSS

SEQ ID NO: 7 - protein, 120 aa, Artificial Sequence
  SD1076
EVQLVESGGGLVQAGGSLTLSCAGSGFAFSIATMGWYRQAPGKQRELVADITSGGSTNYADSVKGRFTISRDNAKNTVYLQMNSLKPEDTAVYYCNADSLATGWRQYSYWGKGTQVTVSS

SEQ ID NO: 8 - protein, 123 aa, Artificial Sequence
  SD1017
EVQLVESGGGLVQAGGSLRLSCAASGRTYAMAWFRQAPGKEREFVAHINALGTRAYYSDSVEGRFTISRDNAKNTGYLQMNSLEPEDTAVYVCAAGGQWRAAPVADAAQYDFWGQGTQVTVSS

SEQ ID NO: 9 - protein, 123 aa, Artificial Sequence
  SD1025
EVQLVESGGGLVQAGGSLRLSCAASGRTYAMAWFRQAPGKEREFVAHINALGTRTYYSDSVQGRFTISRDNAKNTEYLQMNSLKPEDTAVYYCAAGGQWRAAPVADAAQYDFWGQGTQVTVSS

SEQ ID NO: 10 - protein, 122 aa, Artificial Sequence
  SD1070
EVQLVESGGGLVQAGGSLRISCAASGRTFSIYSMGWFRQAPGKEREFVATIGWNSGRTFYADSMKERFTISADNARNTLYLQMNSLKFEDTAVYYCAAAKGPLRLSSQADYWGQGTQVTVSS

SEQ ID NO: 11 - protein, 126 aa, Artificial Sequence
  SD2020
EVQLVESGGGLVQPGGSLRLSCAAAGGAFNRQLVAWFRQAPGKKREFVATVTTSGGSSYYADSVKGRFTISRDTAKNTVALQMNSLKAEDAAVYYCAARDSFTVAPYYPPESYAYWGQGTQVTVSS

SEQ ID NO: 12 - protein, 125 aa, Artificial Sequence
  SD1069
EVQLVESGGGLVQAGDSLRLSCAASGPTFGMSAMGWFRQAPGKEREFVAAISGLGNPNYSDDVKGRFTISRENGRNTVYLQMNSLKPEDTAVYYCAQRKVYHVQGGDRPQAYDYWGQGTQVTVSS

SEQ ID NO: 13 - protein, 122 aa, Artificial Sequence
  SD1046
EVQLVESGGGLVQAGDSLRISCAASGRTLSIYSMGWFRQAPGKEREFVATIGWNSGRTFYPDSLKGRFTISRDNARNTLYLQMNNLRPEDTAVYYCAAAKGPLRLSSQADYWGQGTQVTVSS

SEQ ID NO: 14 - protein, 122 aa, Artificial Sequence
  SD1048
EVQLVESGGGVVQPGGSLRLSCVASGRTSSMYSIGWFRQAPGKEREFVAVIGWYSGRTFYTDSMKGRFTISRDNARNTVYLQMNSLKPEDTAVYYCAAANGPLRLSNQADYWGQGTQVTVSS

SEQ ID NO: 15 - protein, 122 aa, Artificial Sequence
  SD1049
EVQLVESGGGLVQAGGSLRLSCAASGRTLSLYSVGWFRQAPGKEREFVATIGWNSGRTFYVDSMKGRFTISRDNAKNTVYLQMNDLKVEDTAVYYCAAAKGPLRLSNQADYWGQGTQVTVSS

SEQ ID NO: 16 - protein, 124 aa, Artificial Sequence
  SD1027
EVQLVESGGGMVQAGGSLRLSCAASGGTFSLYHMGWFRQAPGEEREFVAAISGSGGNTYYADSVKGRFTISRDNNKNTVYLQMSSLEPEDTAVYFCAAMKWPGILRDANAYDYWGQGTQVTVSS

SEQ ID NO: 17 - protein, 123 aa, Artificial Sequence
  SD1036
EVQLVESGGGLVQAGGSLKLSCAASGRTYAMGWFRQAPGKEREFVAHINALGTRTYYSDSVKGRFTISRDNAKNTEYLEMNNLKPEDTAVYYCTAQGQWRAAPVAVAAEYEFWGQGTQVTVSS

SEQ ID NO: 18 - protein, 123 aa, Artificial Sequence
  SD1014
EVQLVESGGGLVQAGGSLTLSCAASGRTYAMAWFRQAPGKEREFVAHINALGTRTYYSDSVKGRFTISRDNAKNTEYLQMNSLNPEDTAVYYCAAGGQWRAAPVADAAQYDFWGQGTQVTVSS

SEQ ID NO: 19 - protein, 123 aa, Artificial Sequence
  SD1047
EVQLVESGGGLVQAGGSLRISCAASGRTYAMAWFRQAPGKEREFVAHINALGTRTYYSDSVKDRFTISRDNAKNTEYLQMNSLKPEDTAVYYCVAGGQWRAAPVAAAESYDFWGQGTQVTVSS

SEQ ID NO: 20 - protein, 124 aa, Artificial Sequence
  SD1038
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSS

SEQ ID NO: 21 - protein, 115 aa, Artificial Sequence
  SD1045
EVQLVESGGGLVQAGGSLRLSCAASGSSFSINVMGWYRQAPGKQREMVATITYGGSTNYVDSVKGRFTISRDNAKNTVYLQMNSLKPEDTAVYYCNSRLAQINYWGQGTQVTVSS

SEQ ID NO: 22 - protein, 122 aa, Artificial Sequence
  SD1073
EVQLVESGGGLVQAGGSLRLSCAASGSAFSIAAMGWYRQAPGKQRELVATITTGGSTNYADSVKGRFTISRDNSKNTAYLQMNSLKPEDTAVYYCTAKSVVAETFGDLYNYWGQGTQVTVSS

SEQ ID NO: 23 - protein, 117 aa, Artificial Sequence
  SD1034
EVQLVESGGGLVQAGGSLRLSCAASGTIFGIRVNTMGWYRQAPGEQRELVATITRSGGTNYADSVKDRFTISGDFAKDTVYLQMMHLKPEDTAVYYCNGRWALTDYWGQGTQVTVSS

SEQ ID NO: 24 - protein, 129 aa, Artificial Sequence
  SD1083
EVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSS

SEQ ID NO: 25 - protein, 116 aa, Artificial Sequence
  SD1084
EVQLVESGGGLVQPGGSLKLSCAASGFTFSTSWMYWLRQAPGKGLEWVSVINTDGGTYYADSVKDRFTISRDNAKDTLYLQMSSLKSEDTAVYYCAKDWGGPEPTRGQGTQVTVSS

SEQ ID NO: 26 - protein, 127 aa, Artificial Sequence
  SD1085
EVQLVESGGGLVQAGDSLRLSCVISGLSLDTYAVGWFRQAPGKEREGITCISSGHGMTYYADSVKGRFTVSTDNAKNTVYLQMNGLQPEDTARYYCATESRYYCSDNWPAPQRYIYWGQGTQVTVSS

SEQ ID NO: 27 - protein, 127 aa, Artificial Sequence
  SD1087
EVQLVESGGGLVQPGGSLRLSCVISGLSLDTYAVGWFRQAPGKEREGITCISSGHGMTYYADSVKGRFTVSTDNAKNTVYLQMNGLQPEDTARYYCATESRYYCSDNWPAPQRYIYWGQGTQVTVSS

SEQ ID NO: 28 - protein, 116 aa, Artificial Sequence
  SD1086
EVQLVESGGGLVQAGGSLRLSCTASGSISSIDYMRWYRQYPGKHRELVATITSGGAADSRDSVKGRFTVSRGNAANTMYLQMNNLKPEDTAVYYCNAYGLEIGAHWGRGTQVTVSS

SEQ ID NO: 29 - protein, 126 aa, Artificial Sequence
  SD2086
EVQLVESGGGLVQAGGSLRLSCATSGQTFSSYAMGWFRQAPGKEREFVAAISWNGGSTYYADSVKGRFTISRESPENLVYLQMNSLKPEDTAVYYCAARGAYYTGSYYLGSTYDYWGQGTQVTVSS

SEQ ID NO: 30 - protein, 264 aa, Artificial Sequence
  MD1213
EVQLVESGGGLVQAGGSLKLSCAASGRTYAMGWFRQAPGKEREFVAHINALGTRTYYSDSVKGRFTISRDNAKNTEYLEMNNLKPEDTAVYYCTAQGQWRAAPVAVAAEYEFWGQGTQVTVSSAAAGGGGSGGGGSGGGGSEVQLVESGGGLVQAGGSLKLSCAASGRTYAMGWFRQAPGKEREFVAHINALGTRTYYSDSVKGRFTISRDNAKNTEYLEMNNLKPEDTAVYYCTAQGQWRAAPVAVAAEYEFWGQGTQVTVSS

SEQ ID NO: 31 - protein, 284 aa, Artificial Sequence
  MD1209
EVQLVESGGGLVQAGGSLKLSCAASGRTYAMGWFRQAPGKEREFVAHINALGTRTYYSDSVKGRFTISRDNAKNTEYLEMNNLKPEDTAVYYCTAQGQWRAAPVAVAAEYEFWGQGTQVTVSSAAAGGGGSGGGGSGGGGSGGGGSGGGGSGGGGSGGGGSEVQLVESGGGLVQAGGSLKLSCAASGRTYAMGWFRQAPGKEREFVAHINALGTRTYYSDSVKGRFTISRDNAKNTEYLEMNNLKPEDTAVYYCTAQGQWRAAPVAVAAEYEFWGQGTQVTVSS

SEQ ID NO: 32 - protein, 306 aa, Artificial Sequence
  MD1215
EVQLVESGGGLVQAGGSLKLSCAASGRTYAMGWFRQAPGKEREFVAHINALGTRTYYSDSVKGRFTISRDNAKNTEYLEMNNLKPEDTAVYYCTAQGQWRAAPVAVAAEYEFWGQGTQVTVSSAAAGGGGSGGGGSGGGGSGGGGSGGGGGGSGGGGSGGGGSGGGGSGGGGSGGGGSGGGGSEVQLVESGGGLVQAGGSLKLSCAASGRTYAMGWFRQAPGKEREFVAHINALGTRTYYSDSVKGRFTISRDNAKNTEYLEMNNLKPEDTAVYYCTAQGQWRAAPVAVAAEYEFWGQGTQVTVSS

SEQ ID NO: 33 - protein, 265 aa, Artificial Sequence
  MD1214
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSAAAGGGGSGGGGSGGGGSEVQLVESGGGLVQAGGSLKLSCAASGRTYAMGWFRQAPGKEREFVAHINALGTRTYYSDSVKGRFTISRDNAKNTEYLEMNNLKPEDTAVYYCTAQGQWRAAPVAVAAEYEFWGQGTQVTVSS

SEQ ID NO: 34 - protein, 285 aa, Artificial Sequence
  MD1211
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSAAAGGGGSGGGGSGGGGSGGGGSGGGGSGGGGSGGGGSEVQLVESGGGLVQAGGSLKLSCAASGRTYAMGWFRQAPGKEREFVAHINALGTRTYYSDSVKGRFTISRDNAKNTEYLEMNNLKPEDTAVYYCTAQGQWRAAPVAVAAEYEFWGQGTQVTVSS

SEQ ID NO: 35 - protein, 285 aa, Artificial Sequence
  MD1210
EVQLVESGGGLVQAGGSLKLSCAASGRTYAMGWFRQAPGKEREFVAHINALGTRTYYSDSVKGRFTISRDNAKNTEYLEMNNLKPEDTAVYYCTAQGQWRAAPVAVAAEYEFWGQGTQVTVSSAAAGGGGSGGGGSGGGGSGGGGSGGGGSGGGGSGGGGSEVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSS

SEQ ID NO: 36 - protein, 286 aa, Artificial Sequence
  MD1212
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSAAAGGGGSGGGGSGGGGSGGGGSGGGGSGGGGSGGGGSEVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSS

SEQ ID NO: 37 - protein, 307 aa, Artificial Sequence
  MD1216
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSAAAGGGGSGGGGSGGGGSGGGGSGGGGGGSGGGGSGGGGSGGGGSGGGGSGGGGSGGGGSEVQLVESGGGLVQAGGSLKLSCAASGRTYAMGWFRQAPGKEREFVAHINALGTRTYYSDSVKGRFTISRDNAKNTEYLEMNNLKPEDTAVYYCTAQGQWRAAPVAVAAEYEFWGQGTQVTVSS

SEQ ID NO: 38 - protein, 296 aa, Artificial Sequence
  MD1221
EVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSSAAAGGGGSGGGGSGGGGSGGGGSGGGGSGGGGSGGGGSEVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSS

SEQ ID NO: 39 - protein, 283 aa, Artificial Sequence
  MD1222
EVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSSAAAGGGGSGGGGSGGGGSGGGGSGGGGSGGGGSGGGGSEVQLVESGGGLVQPGGSLKLSCAASGFTFSTSWMYWLRQAPGKGLEWVSVINTDGGTYYADSVKDRFTISRDNAKDTLYLQMSSLKSEDTAVYYCAKDWGGPEPTRGQGTQVTVSS

SEQ ID NO: 40 - protein, 283 aa, Artificial Sequence
  MD1223
EVQLVESGGGLVQPGGSLKLSCAASGFTFSTSWMYWLRQAPGKGLEWVSVINTDGGTYYADSVKDRFTISRDNAKDTLYLQMSSLKSEDTAVYYCAKDWGGPEPTRGQGTQVTVSSAAAGGGGSGGGGSGGGGSGGGGSGGGGSGGGGSGGGGSEVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSS

SEQ ID NO: 41 - protein, 270 aa, Artificial Sequence
  MD1224
EVQLVESGGGLVQPGGSLKLSCAASGFTFSTSWMYWLRQAPGKGLEWVSVINTDGGTYYADSVKDRFTISRDNAKDTLYLQMSSLKSEDTAVYYCAKDWGGPEPTRGQGTQVTVSSAAAGGGGSGGGGSGGGGSGGGGSGGGGSGGGGSGGGGSEVQLVESGGGLVQPGGSLKLSCAASGFTFSTSWMYWLRQAPGKGLEWVSVINTDGGTYYADSVKDRFTISRDNAKDTLYLQMSSLKSEDTAVYYCAKDWGGPEPTRGQGTQVTVSS

SEQ ID NO: 42 - protein, 457 aa, Artificial Sequence
  MD1301
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSAAAGGGGSGGGGSGGGGSGGGGSGGGGSGGGGSGGGGSEVQLVESGGGLVQAGGSLKLSCAASGRTYAMGWFRQAPGKEREFVAHINALGTRTYYSDSVKGRFTISRDNAKNTEYLEMNNLKPEDTAVYYCTAQGQWRAAPVAVAAEYEFWGQGTQVTVSSLINLEGGGGSGGGGSGGGGSGGGGSGGGGSGGGGSGGGGSPAGEVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSS

SEQ ID NO: 43 - protein, 444 aa, Artificial Sequence
  MD1302
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSAAAGGGGSGGGGSGGGGSGGGGSGGGGSGGGGSGGGGSEVQLVESGGGLVQAGGSLKLSCAASGRTYAMGWFRQAPGKEREFVAHINALGTRTYYSDSVKGRFTISRDNAKNTEYLEMNNLKPEDTAVYYCTAQGQWRAAPVAVAAEYEFWGQGTQVTVSSLINLEGGGGSGGGGSGGGGSGGGGSGGGGSGGGGSGGGGSPAGEVQLVESGGGLVQPGGSLKLSCAASGFTFSTSWMYWLRQAPGKGLEWVSVINTDGGTYYADSVKDRFTISRDNAKDTLYLQMSSLKSEDTAVYYCAKDWGGPEPTRGQGTQVTVSS

SEQ ID NO: 44 - protein, 396 aa, Artificial Sequence
  MD2301
EVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSSGGGGSGGGGSEVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVQAGGSLKLSCAASGRTYAMGWFRQAPGKEREFVAHINALGTRTYYSDSVKGRFTISRDNAKNTEYLEMNNLKPEDTAVYYCTAQGQWRAAPVAVAAEYEFWGQGTQVTVSS

SEQ ID NO: 45 - protein, 396 aa, Artificial Sequence
  MD2302
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSSGGGGSGGGGSEVQLVESGGGLVQAGGSLKLSCAASGRTYAMGWFRQAPGKEREFVAHINALGTRTYYSDSVKGRFTISRDNAKNTEYLEMNNLKPEDTAVYYCTAQGQWRAAPVAVAAEYEFWGQGTQVTVSS

SEQ ID NO: 46 - protein, 396 aa, Artificial Sequence
  MD2303
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVQAGGSLKLSCAASGRTYAMGWFRQAPGKEREFVAHINALGTRTYYSDSVKGRFTISRDNAKNTEYLEMNNLKPEDTAVYYCTAQGQWRAAPVAVAAEYEFWGQGTQVTVSSGGGGSGGGGSEVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSS

SEQ ID NO: 47 - protein, 397 aa, Artificial Sequence
  MD2304
EVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSSGGGGSGGGGSEVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSS

SEQ ID NO: 48 - protein, 397 aa, Artificial Sequence
  MD2305
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSSGGGGSGGGGSEVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSS

SEQ ID NO: 49 - protein, 397 aa, Artificial Sequence
  MD2306
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSS

SEQ ID NO: 50 - protein, 396 aa, Artificial Sequence
  MD2307
EVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSSGGGGSGGGGSEVQLVESGGGLVQAGDSLRISCAASGRTLSIYSMGWFRQAPGKEREFVATIGWNSGRTFYPDSLKGRFTISRDNARNTLYLQMNNLRPEDTAVYYCAAAKGPLRLSSQADYWGQGTQVTVSSGGGGSGGGGSEVQLVESGGGLVQAGDSLRLSCAASGPTFGMSAMGWFRQAPGKEREFVAAISGLGNPNYSDDVKGRFTISRENGRNTVYLQMNSLKPEDTAVYYCAQRKVYHVQGGDRPQAYDYWGQGTQVTVSS

SEQ ID NO: 51 - protein, 396 aa, Artificial Sequence
  MD2308
EVQLVESGGGLVQAGDSLRISCAASGRTLSIYSMGWFRQAPGKEREFVATIGWNSGRTFYPDSLKGRFTISRDNARNTLYLQMNNLRPEDTAVYYCAAAKGPLRLSSQADYWGQGTQVTVSSGGGGSGGGGSEVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSSGGGGSGGGGSEVQLVESGGGLVQAGDSLRLSCAASGPTFGMSAMGWFRQAPGKEREFVAAISGLGNPNYSDDVKGRFTISRENGRNTVYLQMNSLKPEDTAVYYCAQRKVYHVQGGDRPQAYDYWGQGTQVTVSS

SEQ ID NO: 52 - protein, 396 aa, Artificial Sequence
  MD2309
EVQLVESGGGLVQAGDSLRISCAASGRTLSIYSMGWFRQAPGKEREFVATIGWNSGRTFYPDSLKGRFTISRDNARNTLYLQMNNLRPEDTAVYYCAAAKGPLRLSSQADYWGQGTQVTVSSGGGGSGGGGSEVQLVESGGGLVQAGDSLRLSCAASGPTFGMSAMGWFRQAPGKEREFVAAISGLGNPNYSDDVKGRFTISRENGRNTVYLQMNSLKPEDTAVYYCAQRKVYHVQGGDRPQAYDYWGQGTQVTVSSGGGGSGGGGSEVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSS

SEQ ID NO: 53 - protein, 396 aa, Artificial Sequence
  MD2310
EVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSSGGGGSGGGGSEVQLVESGGGLVQAGDSLRLSCAASGPTFGMSAMGWFRQAPGKEREFVAAISGLGNPNYSDDVKGRFTISRENGRNTVYLQMNSLKPEDTAVYYCAQRKVYHVQGGDRPQAYDYWGQGTQVTVSSGGGGSGGGGSEVQLVESGGGLVQAGDSLRISCAASGRTLSIYSMGWFRQAPGKEREFVATIGWNSGRTFYPDSLKGRFTISRDNARNTLYLQMNNLRPEDTAVYYCAAAKGPLRLSSQADYWGQGTQVTVSS

SEQ ID NO: 54 - protein, 396 aa, Artificial Sequence
  MD2311
EVQLVESGGGLVQAGDSLRLSCAASGPTFGMSAMGWFRQAPGKEREFVAAISGLGNPNYSDDVKGRFTISRENGRNTVYLQMNSLKPEDTAVYYCAQRKVYHVQGGDRPQAYDYWGQGTQVTVSSGGGGSGGGGSEVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSSGGGGSGGGGSEVQLVESGGGLVQAGDSLRISCAASGRTLSIYSMGWFRQAPGKEREFVATIGWNSGRTFYPDSLKGRFTISRDNARNTLYLQMNNLRPEDTAVYYCAAAKGPLRLSSQADYWGQGTQVTVSS

SEQ ID NO: 55 - protein, 396 aa, Artificial Sequence
  MD2312
EVQLVESGGGLVQAGDSLRLSCAASGPTFGMSAMGWFRQAPGKEREFVAAISGLGNPNYSDDVKGRFTISRENGRNTVYLQMNSLKPEDTAVYYCAQRKVYHVQGGDRPQAYDYWGQGTQVTVSSGGGGSGGGGSEVQLVESGGGLVQAGDSLRISCAASGRTLSIYSMGWFRQAPGKEREFVATIGWNSGRTFYPDSLKGRFTISRDNARNTLYLQMNNLRPEDTAVYYCAAAKGPLRLSSQADYWGQGTQVTVSSGGGGSGGGGSEVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSS

SEQ ID NO: 56 - protein, 393 aa, Artificial Sequence
  MD2313
EVQLVESGGGLVQAGDSLRISCAASGRTLSIYSMGWFRQAPGKEREFVATIGWNSGRTFYPDSLKGRFTISRDNARNTLYLQMNNLRPEDTAVYYCAAAKGPLRLSSQADYWGQGTQVTVSSGGGGSGGGGSEVQLVESGGGLVQAGDSLRISCAASGRTLSIYSMGWFRQAPGKEREFVATIGWNSGRTFYPDSLKGRFTISRDNARNTLYLQMNNLRPEDTAVYYCAAAKGPLRLSSQADYWGQGTQVTVSSGGGGSGGGGSEVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSS

SEQ ID NO: 57 - protein, 399 aa, Artificial Sequence
  MD2314
EVQLVESGGGLVQAGDSLRLSCAASGPTFGMSAMGWFRQAPGKEREFVAAISGLGNPNYSDDVKGRFTISRENGRNTVYLQMNSLKPEDTAVYYCAQRKVYHVQGGDRPQAYDYWGQGTQVTVSSGGGGSGGGGSEVQLVESGGGLVQAGDSLRLSCAASGPTFGMSAMGWFRQAPGKEREFVAAISGLGNPNYSDDVKGRFTISRENGRNTVYLQMNSLKPEDTAVYYCAQRKVYHVQGGDRPQAYDYWGQGTQVTVSSGGGGSGGGGSEVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSS

SEQ ID NO: 58 - protein, 395 aa, Artificial Sequence
  MD2317
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVQAGDSLRISCAASGRTLSIYSMGWFRQAPGKEREFVATIGWNSGRTFYPDSLKGRFTISRDNARNTLYLQMNNLRPEDTAVYYCAAAKGPLRLSSQADYWGQGTQVTVSSGGGGSGGGGSEVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSS

SEQ ID NO: 59 - protein, 395 aa, Artificial Sequence
  MD2320
EVQLVESGGGLVQAGDSLRISCAASGRTLSIYSMGWFRQAPGKEREFVATIGWNSGRTFYPDSLKGRFTISRDNARNTLYLQMNNLRPEDTAVYYCAAAKGPLRLSSQADYWGQGTQVTVSSGGGGSGGGGSEVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSS

SEQ ID NO: 60 - protein, 392 aa, Artificial Sequence
  MD2322
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSS

SEQ ID NO: 61 - protein, 624 aa, Artificial Sequence
  MD2401
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSAAAGGGGSGGGGSGGGGSGGGGSGGGGSGGGGSGGGGSEVQLVESGGGLVQAGGSLKLSCAASGRTYAMGWFRQAPGKEREFVAHINALGTRTYYSDSVKGRFTISRDNAKNTEYLEMNNLKPEDTAVYYCTAQGQWRAAPVAVAAEYEFWGQGTQVTVSSLINLEGGGGSGGGGSGGGGSGGGGSGGGGSGGGGSGGGGSPAGEVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSSAAAGGGGSGGGGSGGGGSGGGGSGGGGSGGGGSGGGGSEVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSS

SEQ ID NO: 62 - protein, 611 aa, Artificial Sequence
  MD2402
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSAAAGGGGSGGGGSGGGGSGGGGSGGGGSGGGGSGGGGSEVQLVESGGGLVQAGGSLKLSCAASGRTYAMGWFRQAPGKEREFVAHINALGTRTYYSDSVKGRFTISRDNAKNTEYLEMNNLKPEDTAVYYCTAQGQWRAAPVAVAAEYEFWGQGTQVTVSSLINLEGGGGSGGGGSGGGGSGGGGSGGGGSGGGGSGGGGSPAGEVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSSAAAGGGGSGGGGSGGGGSGGGGSGGGGSGGGGSGGGGSEVQLVESGGGLVQPGGSLKLSCAASGFTFSTSWMYWLRQAPGKGLEWVSVINTDGGTYYADSVKDRFTISRDNAKDTLYLQMSSLKSEDTAVYYCAKDWGGPEPTRGQGTQVTVSS

SEQ ID NO: 63 - protein, 611 aa, Artificial Sequence
  MD2403
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSAAAGGGGSGGGGSGGGGSGGGGSGGGGSGGGGSGGGGSEVQLVESGGGLVQAGGSLKLSCAASGRTYAMGWFRQAPGKEREFVAHINALGTRTYYSDSVKGRFTISRDNAKNTEYLEMNNLKPEDTAVYYCTAQGQWRAAPVAVAAEYEFWGQGTQVTVSSLINLEGGGGSGGGGSGGGGSGGGGSGGGGSGGGGSGGGGSPAGEVQLVESGGGLVQPGGSLKLSCAASGFTFSTSWMYWLRQAPGKGLEWVSVINTDGGTYYADSVKDRFTISRDNAKDTLYLQMSSLKSEDTAVYYCAKDWGGPEPTRGQGTQVTVSSAAAGGGGSGGGGSGGGGSGGGGSGGGGSGGGGSGGGGSEVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSS

SEQ ID NO: 64 - protein, 598 aa, Artificial Sequence
  MD2404
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSAAAGGGGSGGGGSGGGGSGGGGSGGGGSGGGGSGGGGSEVQLVESGGGLVQAGGSLKLSCAASGRTYAMGWFRQAPGKEREFVAHINALGTRTYYSDSVKGRFTISRDNAKNTEYLEMNNLKPEDTAVYYCTAQGQWRAAPVAVAAEYEFWGQGTQVTVSSLINLEGGGGSGGGGSGGGGSGGGGSGGGGSGGGGSGGGGSPAGEVQLVESGGGLVQPGGSLKLSCAASGFTFSTSWMYWLRQAPGKGLEWVSVINTDGGTYYADSVKDRFTISRDNAKDTLYLQMSSLKSEDTAVYYCAKDWGGPEPTRGQGTQVTVSSAAAGGGGSGGGGSGGGGSGGGGSGGGGSGGGGSGGGGSEVQLVESGGGLVQPGGSLKLSCAASGFTFSTSWMYWLRQAPGKGLEWVSVINTDGGTYYADSVKDRFTISRDNAKDTLYLQMSSLKSEDTAVYYCAKDWGGPEPTRGQGTQVTVSS

SEQ ID NO: 65 - protein, 599 aa, Artificial Sequence
  MD2405
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSAAAGGGGSGGGGSGGGGSGGGGSGGGGSGGGGSGGGGSEVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSLINLEGGGGSGGGGSGGGGSGGGGSGGGGSGGGGSGGGGSPAGEVQLVESGGGLVQPGGSLKLSCAASGFTFSTSWMYWLRQAPGKGLEWVSVINTDGGTYYADSVKDRFTISRDNAKDTLYLQMSSLKSEDTAVYYCAKDWGGPEPTRGQGTQVTVSSAAAGGGGSGGGGSGGGGSGGGGSGGGGSGGGGSGGGGSEVQLVESGGGLVQPGGSLKLSCAASGFTFSTSWMYWLRQAPGKGLEWVSVINTDGGTYYADSVKDRFTISRDNAKDTLYLQMSSLKSEDTAVYYCAKDWGGPEPTRGQGTQVTVSS

SEQ ID NO: 66 - protein, 526 aa, Artificial Sequence
  MD2406
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSS

SEQ ID NO: 67 - protein, 522 aa, Artificial Sequence
  MD2407
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVQAGGSLKLSCAASGRTYAMGWFRQAPGKEREFVAHINALGTRTYYSDSVKGRFTISRDNAKNTEYLEMNNLKPEDTAVYYCTAQGQWRAAPVAVAAEYEFWGQGTQVTVSSGGGGSGGGGSEVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSSGGGGSGGGGSEVQLVESGGGLVQPGGSLKLSCAASGFTFSTSWMYWLRQAPGKGLEWVSVINTDGGTYYADSVKDRFTISRDNAKDTLYLQMSSLKSEDTAVYYCAKDWGGPEPTRGQGTQVTVSS

SEQ ID NO: 68 - protein, 523 aa, Artificial Sequence
  MD3401
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSSGGGGSGGGGSEVQLVESGGGLVQPGGSLKLSCAASGFTFSTSWMYWLRQAPGKGLEWVSVINTDGGTYYADSVKDRFTISRDNAKDTLYLQMSSLKSEDTAVYYCAKDWGGPEPTRGQGTQVTVSS

SEQ ID NO: 69 - protein, 521 aa, Artificial Sequence
  MD3402
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVQAGDSLRISCAASGRTLSIYSMGWFRQAPGKEREFVATIGWNSGRTFYPDSLKGRFTISRDNARNTLYLQMNNLRPEDTAVYYCAAAKGPLRLSSQADYWGQGTQVTVSSGGGGSGGGGSEVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSSGGGGSGGGGSEVQLVESGGGLVQPGGSLKLSCAASGFTFSTSWMYWLRQAPGKGLEWVSVINTDGGTYYADSVKDRFTISRDNAKDTLYLQMSSLKSEDTAVYYCAKDWGGPEPTRGQGTQVTVSS

SEQ ID NO: 70 - protein, 523 aa, Artificial Sequence
  MD3403
EVQLVESGGGLVQAGDSLRLSCAASGPTFGMSAMGWFRQAPGKEREFVAAISGLGNPNYADDVKGRFTISREDGRNTVYLQMNSLKPEDTAVYYCAQRKVYHVQGGDRPQAYDYWGQGTQVTVSSGGGGSGGGGSEVQLVESGGGLVQAGGSLKLSCAASGRTYAMGWFRQAPGKEREFVAHINALGTRTYYSDSVKGRFTISRDNAKNTEYLEMNNLKPEDTAVYYCTAQGQWRAAPVAVAAEYEFWGQGTQVTVSSGGGGSGGGGSEVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSSGGGGSGGGGSEVQLVESGGGLVQPGGSLKLSCAASGFTFSTSWMYWLRQAPGKGLEWVSVINTDGGTYYADSVKDRFTISRDNAKDTLYLQMSSLKSEDTAVYYCAKDWGGPEPTRGQGTQVTVSS

SEQ ID NO: 71 - protein, 520 aa, Artificial Sequence
  MD3404
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVQAGGSLKLSCAASGRTYAMGWFRQAPGKEREFVAHINALGTRTYYSDSVKGRFTISRDNAKNTEYLEMNNLKPEDTAVYYCTAQGQWRAAPVAVAAEYEFWGQGTQVTVSSGGGGSGGGGSEVQLVESGGGLVQPGGSLRLSCVISGLSLDTYAVGWFRQAPGKEREGITCISSGHGMTYYADSVKGRFTVSTDNAKNTVYLQMNGLQPEDTARYYCATESRYYCSDNWPAPQRYIYWGQGTQVTVSSGGGGSGGGGSEVQLVESGGGLVQPGGSLKLSCAASGFTFSTSWMYWLRQAPGKGLEWVSVINTDGGTYYADSVKDRFTISRDNAKDTLYLQMSSLKSEDTAVYYCAKDWGGPEPTRGQGTQVTVSS

SEQ ID NO: 72 - protein, 519 aa, Artificial Sequence
  MD3405
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVQAGGSLKLSCAASGRTYAMGWFRQAPGKEREFVAHINALGTRTYYSDSVKGRFTISRDNAKNTEYLEMNNLKPEDTAVYYCTAQGQWRAAPVAVAAEYEFWGQGTQVTVSSGGGGSGGGGSEVQLVESGGGLVQAGGSLRLSCATSGQTFSSYAMGWFRQAPGKEREFVAAISWNGGSTYYADSVKGRFTISRESPENLVYLQMNSLKPEDTAVYYCAARGAYYTGSYYLGSTYDYWGQGTQVTVSSGGGGSGGGGSEVQLVESGGGLVQPGGSLKLSCAASGFTFSTSWMYWLRQAPGKGLEWVSVINTDGGTYYADSVKDRFTISRDNAKDTLYLQMSSLKSEDTAVYYCAKDWGGPEPTRGQGTQVTVSS

SEQ ID NO: 73 - protein, 656 aa, Artificial Sequence
  MD2501
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVQAGGSLKLSCAASGRTYAMGWFRQAPGKEREFVAHINALGTRTYYSDSVKGRFTISRDNAKNTEYLEMNNLKPEDTAVYYCTAQGQWRAAPVAVAAEYEFWGQGTQVTVSSGGGGSGGGGSEVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSSGGGGSGGGGSEVQLVESGGGLVQPGGSLKLSCAASGFTFSTSWMYWLRQAPGKGLEWVSVINTDGGTYYADSVKDRFTISRDNAKDTLYLQMSSLKSEDTAVYYCAKDWGGPEPTRGQGTQVTVSS

SEQ ID NO: 74 - protein, 354 aa, Artificial Sequence
  MD2605
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSAAADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 75 - protein, 364 aa, Artificial Sequence
  MD2606
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSAAADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 76 - protein, 359 aa, Artificial Sequence
  MD2607
EVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSSAAADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 77 - protein, 369 aa, Artificial Sequence
  MD2608
EVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSSGGGGSGGGGSAAADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 78 - protein, 346 aa, Artificial Sequence
  MD2609
EVQLVESGGGLVQPGGSLKLSCAASGFTFSTSWMYWLRQAPGKGLEWVSVINTDGGTYYADSVKDRFTISRDNAKDTLYLQMSSLKSEDTAVYYCAKDWGGPEPTRGQGTQVTVSSAAADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 79 - protein, 356 aa, Artificial Sequence
  MD2610
EVQLVESGGGLVQPGGSLKLSCAASGFTFSTSWMYWLRQAPGKGLEWVSVINTDGGTYYADSVKDRFTISRDNAKDTLYLQMSSLKSEDTAVYYCAKDWGGPEPTRGQGTQVTVSSGGGGSGGGGSAAADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 80 - protein, 526 aa, Artificial Sequence
  MD2601
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSAAAGGGGSGGGGSGGGGSGGGGSGGGGSGGGGSGGGGSEVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSSLINLEAAADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 81 - protein, 513 aa, Artificial Sequence
  MD2602
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSAAAGGGGSGGGGSGGGGSGGGGSGGGGSGGGGSGGGGSEVQLVESGGGLVQPGGSLKLSCAASGFTFSTSWMYWLRQAPGKGLEWVSVINTDGGTYYADSVKDRFTISRDNAKDTLYLQMSSLKSEDTAVYYCAKDWGGPEPTRGQGTQVTVSSLINLEAAADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 82 - protein, 526 aa, Artificial Sequence
  MD2603
EVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSSAAAGGGGSGGGGSGGGGSGGGGSGGGGSGGGGSGGGGSEVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSLINLEAAADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 83 - protein, 513 aa, Artificial Sequence
  MD2604
EVQLVESGGGLVQPGGSLKLSCAASGFTFSTSWMYWLRQAPGKGLEWVSVINTDGGTYYADSVKDRFTISRDNAKDTLYLQMSSLKSEDTAVYYCAKDWGGPEPTRGQGTQVTVSSAAAGGGGSGGGGSGGGGSGGGGSGGGGSGGGGSGGGGSEVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSLINLEAAADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 84 - protein, 493 aa, Artificial Sequence
  MD2611
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSSAAADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 85 - protein, 493 aa, Artificial Sequence
  MD2612
EVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSSGGGGSGGGGSEVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSAAADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 86 - protein, 480 aa, Artificial Sequence
  MD2613
EVQLVESGGGLVQPGGSLKLSCAASGFTFSTSWMYWLRQAPGKGLEWVSVINTDGGTYYADSVKDRFTISRDNAKDTLYLQMSSLKSEDTAVYYCAKDWGGPEPTRGQGTQVTVSSGGGGSGGGGSEVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSAAADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 87 - protein, 480 aa, Artificial Sequence
  MD2614
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVQPGGSLKLSCAASGFTFSTSWMYWLRQAPGKGLEWVSVINTDGGTYYADSVKDRFTISRDNAKDTLYLQMSSLKSEDTAVYYCAKDWGGPEPTRGQGTQVTVSSAAADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 88 - protein, 493 aa, Artificial Sequence
  MD2615
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSAAADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSEVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSS

SEQ ID NO: 89 - protein, 493 aa, Artificial Sequence
  MD2616
EVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSSAAADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSEVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSS

SEQ ID NO: 90 - protein, 480 aa, Artificial Sequence
  MD2617
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSAAADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSEVQLVESGGGLVQPGGSLKLSCAASGFTFSTSWMYWLRQAPGKGLEWVSVINTDGGTYYADSVKDRFTISRDNAKDTLYLQMSSLKSEDTAVYYCAKDWGGPEPTRGQGTQVTVSS

SEQ ID NO: 91 - protein, 480 aa, Artificial Sequence
  MD2618
EVQLVESGGGLVQPGGSLKLSCAASGFTFSTSWMYWLRQAPGKGLEWVSVINTDGGTYYADSVKDRFTISRDNAKDTLYLQMSSLKSEDTAVYYCAKDWGGPEPTRGQGTQVTVSSAAADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSEVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSS

SEQ ID NO: 92 - protein, 513 aa, Artificial Sequence
  MD2626
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSAAADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSEVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSS

SEQ ID NO: 93 - protein, 626 aa, Artificial Sequence
  MD2619
EVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSSGGGGSGGGGSEVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVQAGGSLKLSCAASGRTYAMGWFRQAPGKEREFVAHINALGTRTYYSDSVKGRFTISRDNAKNTEYLEMNNLKPEDTAVYYCTAQGQWRAAPVAVAAEYEFWGQGTQVTVSSAAADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 94 - protein, 626 aa, Artificial Sequence
  MD2620
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSSGGGGSGGGGSEVQLVESGGGLVQAGGSLKLSCAASGRTYAMGWFRQAPGKEREFVAHINALGTRTYYSDSVKGRFTISRDNAKNTEYLEMNNLKPEDTAVYYCTAQGQWRAAPVAVAAEYEFWGQGTQVTVSSAAADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 95 - protein, 626 aa, Artificial Sequence
  MD2621
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVQAGGSLKLSCAASGRTYAMGWFRQAPGKEREFVAHINALGTRTYYSDSVKGRFTISRDNAKNTEYLEMNNLKPEDTAVYYCTAQGQWRAAPVAVAAEYEFWGQGTQVTVSSGGGGSGGGGSEVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSSAAADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 96 - protein, 626 aa, Artificial Sequence
  MD2628
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVQAGGSLKLSCAASGRTYAMGWFRQAPGKEREFVAHINALGTRTYYSDSVKGRFTISRDNAKNTEYLEMNNLKPEDTAVYYCTAQGQWRAAPVAVAAEYEFWGQGTQVTVSSAAADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSEVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSS

SEQ ID NO: 97 - protein, 626 aa, Artificial Sequence
  MD2629
EVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSSAAADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSEVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVQAGGSLKLSCAASGRTYAMGWFRQAPGKEREFVAHINALGTRTYYSDSVKGRFTISRDNAKNTEYLEMNNLKPEDTAVYYCTAQGQWRAAPVAVAAEYEFWGQGTQVTVSS

SEQ ID NO: 98 - protein, 749 aa, Artificial Sequence
  MD2641
EVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSSGGGGSGGGGSEVQLVESGGGLVQPGGSLKLSCAASGFTFSTSWMYWLRQAPGKGLEWVSVINTDGGTYYADSVKDRFTISRDNAKDTLYLQMSSLKSEDTAVYYCAKDWGGPEPTRGQGTQVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSEVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVQAGGSLKLSCAASGRTYAMGWFRQAPGKEREFVAHINALGTRTYYSDSVKGRFTISRDNAKNTEYLEMNNLKPEDTAVYYCTAQGQWRAAPVAVAAEYEFWGQGTQVTVSS

SEQ ID NO: 99 - protein, 749 aa, Artificial Sequence
  MD2642
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVQAGGSLKLSCAASGRTYAMGWFRQAPGKEREFVAHINALGTRTYYSDSVKGRFTISRDNAKNTEYLEMNNLKPEDTAVYYCTAQGQWRAAPVAVAAEYEFWGQGTQVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSEVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSSGGGGSGGGGSEVQLVESGGGLVQPGGSLKLSCAASGFTFSTSWMYWLRQAPGKGLEWVSVINTDGGTYYADSVKDRFTISRDNAKDTLYLQMSSLKSEDTAVYYCAKDWGGPEPTRGQGTQVTVSS

SEQ ID NO: 100 - protein, 749 aa, Artificial Sequence
  MD3606
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVQAGGSLKLSCAASGRTYAMGWFRQAPGKEREFVAHINALGTRTYYSDSVKGRFTISRDNAKNTEYLEMNNLKPEDTAVYYCTAQGQWRAAPVAVAAEYEFWGQGTQVTVSSGGGGSGGGGSEVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSSGGGGSGGGGSEVQLVESGGGLVQPGGSLKLSCAASGFTFSTSWMYWLRQAPGKGLEWVSVINTDGGTYYADSVKDRFTISRDNAKDTLYLQMSSLKSEDTAVYYCAKDWGGPEPTRGQGTQVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 101 - protein, 752 aa, Artificial Sequence
  MD3609
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVQAGGSLKLSCAASGRTYAMGWFRQAPGKEREFVAHINALGTRTYYSDSVKGRFTISRDNAKNTEYLEMNNLKPEDTAVYYCTAQGQWRAAPVAVAAEYEFWGQGTQVTVSSGGGGSGGGGSEVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSSGGGGSGGGGSEVQLVESGGGLVQPGGSLKLSCAASGFTFSTSWMYWLRQAPGKGLEWVSVINTDGGTYYADSVKDRFTISRDNAKDTLYLQMSSLKSEDTAVYYCAKDWGGPEPTRGQGTQVTVSSAAADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 102 - protein, 883 aa, Artificial Sequence
  MD2631
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVQAGGSLKLSCAASGRTYAMGWFRQAPGKEREFVAHINALGTRTYYSDSVKGRFTISRDNAKNTEYLEMNNLKPEDTAVYYCTAQGQWRAAPVAVAAEYEFWGQGTQVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSEVQLVESGGGLVQPGGSLKLSCAASGFTFSTSWMYWLRQAPGKGLEWVSVINTDGGTYYADSVKDRFTISRDNAKDTLYLQMSSLKSEDTAVYYCAKDWGGPEPTRGQGTQVTVSSGGGGSGGGGSEVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSS

SEQ ID NO: 103 - protein, 883 aa, Artificial Sequence
  MD2632
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVQAGGSLKLSCAASGRTYAMGWFRQAPGKEREFVAHINALGTRTYYSDSVKGRFTISRDNAKNTEYLEMNNLKPEDTAVYYCTAQGQWRAAPVAVAAEYEFWGQGTQVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSEVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSSGGGGSGGGGSEVQLVESGGGLVQPGGSLKLSCAASGFTFSTSWMYWLRQAPGKGLEWVSVINTDGGTYYADSVKDRFTISRDNAKDTLYLQMSSLKSEDTAVYYCAKDWGGPEPTRGQGTQVTVSS

SEQ ID NO: 104 - protein, 883 aa, Artificial Sequence
  MD2633
EVQLVESGGGLVQAGGSLKLSCAASGRTYAMGWFRQAPGKEREFVAHINALGTRTYYSDSVKGRFTISRDNAKNTEYLEMNNLKPEDTAVYYCTAQGQWRAAPVAVAAEYEFWGQGTQVTVSSGGGGSGGGGSEVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSEVQLVESGGGLVQPGGSLKLSCAASGFTFSTSWMYWLRQAPGKGLEWVSVINTDGGTYYADSVKDRFTISRDNAKDTLYLQMSSLKSEDTAVYYCAKDWGGPEPTRGQGTQVTVSSGGGGSGGGGSEVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSS

SEQ ID NO: 105 - protein, 883 aa, Artificial Sequence
  MD2634
EVQLVESGGGLVQAGGSLKLSCAASGRTYAMGWFRQAPGKEREFVAHINALGTRTYYSDSVKGRFTISRDNAKNTEYLEMNNLKPEDTAVYYCTAQGQWRAAPVAVAAEYEFWGQGTQVTVSSGGGGSGGGGSEVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSEVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSSGGGGSGGGGSEVQLVESGGGLVQPGGSLKLSCAASGFTFSTSWMYWLRQAPGKGLEWVSVINTDGGTYYADSVKDRFTISRDNAKDTLYLQMSSLKSEDTAVYYCAKDWGGPEPTRGQGTQVTVSS

SEQ ID NO: 106 - protein, 487 aa, Artificial Sequence
  MD2622
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVQAGGSLKLSCAASGRTYAMGWFRQAPGKEREFVAHINALGTRTYYSDSVKGRFTISRDNAKNTEYLEMNNLKPEDTAVYYCTAQGQWRAAPVAVAAEYEFWGQGTQVTVSSAAADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSRLTVDKSRWQQGNVFSCSVMHEALHNHYTQKSLSLSPGK

SEQ ID NO: 107 - protein, 359 aa, Artificial Sequence
  MD2622
EVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSSAAADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 108-109 - skipped (2 entries)

SEQ ID NO: 110 - protein, 618 aa, Artificial Sequence
  MD2643
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVQAGGSLKLSCAASGRTYAMGWFRQAPGKEREFVAHINALGTRTYYSDSVKGRFTISRDNAKNTEYLEMNNLKPEDTAVYYCTAQGQWRAAPVAVAAEYEFWGQGTQVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSRLTVDKSRWQQGNVFSCSVMHEALHNHYTQKSLSLSPGK

SEQ ID NO: 111 - protein, 482 aa, Artificial Sequence
  MD2643
EVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSSGGGGSGGGGSEVQLVESGGGLVQPGGSLKLSCAASGFTFSTSWMYWLRQAPGKGLEWVSVINTDGGTYYADSVKDRFTISRDNAKDTLYLQMSSLKSEDTAVYYCAKDWGGPEPTRGQGTQVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 112 - protein, 618 aa, Artificial Sequence; identical to SEQ ID NO: 110
  MD2644

SEQ ID NO: 113 - protein, 482 aa, Artificial Sequence
  MD2644
EVQLVESGGGLVQPGGSLKLSCAASGFTFSTSWMYWLRQAPGKGLEWVSVINTDGGTYYADSVKDRFTISRDNAKDTLYLQMSSLKSEDTAVYYCAKDWGGPEPTRGQGTQVTVSSGGGGSGGGGSEVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 114 - protein, 618 aa, Artificial Sequence
  MD2645
EVQLVESGGGLVQAGGSLKLSCAASGRTYAMGWFRQAPGKEREFVAHINALGTRTYYSDSVKGRFTISRDNAKNTEYLEMNNLKPEDTAVYYCTAQGQWRAAPVAVAAEYEFWGQGTQVTVSSGGGGSGGGGSEVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSRLTVDKSRWQQGNVFSCSVMHEALHNHYTQKSLSLSPGK

SEQ ID NO: 115 - protein, 482 aa, Artificial Sequence; identical to SEQ ID NO: 111
  MD2645

SEQ ID NO: 116 - protein, 618 aa, Artificial Sequence; identical to SEQ ID NO: 114
  MD2646

SEQ ID NO: 117 - protein, 482 aa, Artificial Sequence; identical to SEQ ID NO: 113
  MD2646

SEQ ID NO: 118 - protein, 490 aa, Artificial Sequence
  MD2647
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSRLTVDKSRWQQGNVFSCSVMHEALHNHYTQKSLSLSPGKGGGGSGGGGSEVQLVESGGGLVQPGGSLRLSCAATGFTLENKAIGWFRQTPGSEREGVLCISKSGSWTYYTDSMRGRFTISRDNAENTVYLQMDSLKPEDTAVYYCATTTAGGGLCWDGTTFSRLASSWGQGTQVTVSS

SEQ ID NO: 119 - protein, 610 aa, Artificial Sequence
  MD2647
EVQLVESGGGLVQAGGSLKLSCAASGRTYAMGWFRQAPGKEREFVAHINALGTRTYYSDSVKGRFTISRDNAKNTEYLEMNNLKPEDTAVYYCTAQGQWRAAPVAVAAEYEFWGQGTQVTVSSGGGGSGGGGSEVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGKGGGGSGGGGSEVQLVESGGGLVQPGGSLKLSCAASGFTFSTSWMYWLRQAPGKGLEWVSVINTDGGTYYADSVKDRFTISRDNAKDTLYLQMSSLKSEDTAVYYCAKDWGGPEPTRGQGTQVTVSS

SEQ ID NO: 120 - protein, 484 aa, Artificial Sequence
  MD2649
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGMGVYWGKGALVTVSSGGGGSGGGGSEVQLVESGGGLVQAGGSLKLSCAASGRTYAMGWFRQAPGKEREFVAHINALGTRTYYSDSVKGRFTISRDNAKNTEYLEMNNLKPEDTAVYYCTAQGQWRAAPVAVAAEYEFWGQGTQVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSRLTVDKSRWQQGNVFSCSVMHEALHNHYTQKSLSLSPGK

SEQ ID NO: 121 - protein, 482 aa, Artificial Sequence; identical to SEQ ID NO: 111
  MD2649

SEQ ID NO: 122 - protein, 7 aa, Artificial Sequence
  CDR2 SD1043
TITRSGG

SEQ ID NO: 123 - protein, 9 aa, Artificial Sequence
  CDR3 SD1034
NGRWALTDY

SEQ ID NO: 124 - protein, 9 aa, Artificial Sequence
  CDR1 SD1083
FTLENKAIG

SEQ ID NO: 125 - protein, 8 aa, Artificial Sequence
  CDR2 SD1083
CISKSGSW

SEQ ID NO: 126 - protein, 22 aa, Artificial Sequence
  CDR3 SD1083
ATTTAGGGLCWDGTTFSRLASS

SEQ ID NO: 127 - protein, 9 aa, Artificial Sequence
  CDR1 SD1084
FTFSTSWMY

SEQ ID NO: 128 - protein, 7 aa, Artificial Sequence
  CDR2 SD1084
VINTDGG

SEQ ID NO: 129 - protein, 10 aa, Artificial Sequence
  CDR3 SD1084
AKDWGGPEPT

SEQ ID NO: 130 - protein, 9 aa, Artificial Sequence
  CDR1 SD1085
LSLDTYAVG

SEQ ID NO: 131 - protein, 8 aa, Artificial Sequence
  CDR2 SD1085
CISSGHGM

SEQ ID NO: 132 - protein, 20 aa, Artificial Sequence
  CDR3 SD1085
ATESRYYCSDNWPAPQRYIY

SEQ ID NO: 133 - protein, 9 aa, Artificial Sequence
  CDR1 SD1087
LSLDTYAVG

SEQ ID NO: 134 - protein, 8 aa, Artificial Sequence
  CDR2 SD1087
CISSGHGM

SEQ ID NO: 135 - protein, 8 aa, Artificial Sequence
  CDR3 SD1087
CISSGHGM

SEQ ID NO: 136 - protein, 9 aa, Artificial Sequence
  CDR1 SD1086
SISSIDYMR

SEQ ID NO: 137 - protein, 7 aa, Artificial Sequence
  CDR2 SD1086
TITSGGA

SEQ ID NO: 138 - protein, 10 aa, Artificial Sequence
  CDR3 SD1086
NAYGLEIGAH

SEQ ID NO: 139 - protein, 9 aa, Artificial Sequence
  CDR1 SD2086
QTFSSYAMG

SEQ ID NO: 140 - protein, 8 aa, Artificial Sequence
  CDR2 SD2086
AISWNGGS

SEQ ID NO: 141 - protein, 19 aa, Artificial Sequence
  CDR3 SD2086
AARGAYYTGSYYLGSTYDY

SEQ ID NO: 142 - protein, 10 aa, Artificial Sequence
  10 GS linker
GGGGSGGGGS

SEQ ID NO: 143 - protein, 15 aa, Artificial Sequence
  15 GS linker
GGGGSGGGGSGGGGS

SEQ ID NO: 144 - protein, 35 aa, Artificial Sequence
  35 GS linker
GGGGSGGGGSGGGGSGGGGSGGGGSGGGGSGGGGS

SEQ ID NO: 145 - protein, 57 aa, Artificial Sequence
  57 GS linker
GGGGSGGGGSGGGGSGGGGSGGGGGGSGGGGSGGGGSGGGGSGGGGSGGGGSGGGGS

SEQ ID NO: 146 - protein, 123 aa, Artificial Sequence
  SD3023
EVQLLESGGGLVQAGGSLRLSCAASGRTYAMSWFRQAPGKEREFVSHINALGTRTYYADSVKGRFTISRDNSKNTLYLQMNSLRPEDTAVYYCTAQGQWRAAPVAVAAEYEFWGQGTQVTVSS

SEQ ID NO: 147 - protein, 123 aa, Artificial Sequence
  SD3024
EVQLLESGGGLVQPGGSLRLSCAASGRTYAMSWFRQAPGKEREFVSHINALGTRTYYADSVKGRFTISRDNSKNTLYLQMNSLRAEDTAVYYCTAQGQWRAAPVAVAAEYEFWGQGTQVTVSS

SEQ ID NO: 148 - protein, 123 aa, Artificial Sequence
  SD3025
EVQLLESGGGLVQPGGSLRLSCAASGRTYAMSWFRQAPGKEREFVAHINALGTRTYYADSVKGRFTISRDNSKNTLYLQMNSLRAEDTAVYYCTAQGQWRAAPVAVAAEYEFWGQGTQVTVSS

SEQ ID NO: 149 - protein, 123 aa, Artificial Sequence
  SD3026
EVQLLESGGGLVQPGGSLRLSCAASGRTYAMSWFRQAPGKEREFVSAINALGTRTYYADSVKGRFTISRDNSKNTLYLQMNSLRAEDTAVYYCTAQGQWRAAPVAVAAEYEFWGQGTQVTVSS

SEQ ID NO: 150 - protein, 123 aa, Artificial Sequence
  SD3027
EVQLLESGGGLVQAGGSLRLSCAASGRTYAMSWFRQAPGKEREFVSAINALGTRTYYADSVKGRFTISRDNSKNTLYLQMNSLRPEDTAVYYCTAQGQWRAAPVAVAAEYEFWGQGTQVTVSS

SEQ ID NO: 151 - protein, 123 aa, Artificial Sequence
  SD3028
EVQLLESGGGLVQAGGSLRLSCAASGRTYAMSWFRQAPGKEREFVAHINALGTRTYYADSVKGRFTISRDNSKNTLYLQMNSLRPEDTAVYYCTAQGQWRAAPVAVAAEYEFWGQGTQVTVSS

SEQ ID NO: 152 - protein, 123 aa, Artificial Sequence
  SD3094
EVQLLESGGGLVQPGGSLRLSCAASGRTYAMGWFRQAPGKEREFVAHINALGTRTYYADSVKGRFTISRDNSKNTLYLQMNSLRAEDTAVYYCTAQGQWRAAPVAVAAEYEFWGQGTLVTVSS

SEQ ID NO: 153 - protein, 123 aa, Artificial Sequence
  SD3095
EVQLLESGGGLVQPGGSLRLSCAASGRTYAMGWFRQAPGKEREFVAHINALGTRTYYADSVKGRFTISRDNSKNTLYLQMNSLRPEDTAVYYCTAQGQWRAAPVAVAAEYEFWGQGTLVTVSS

SEQ ID NO: 154 - protein, 123 aa, Artificial Sequence
  SD3096
EVQLLESGGGLVQPGGSLRLSCAASGRTYAMGWFRQAPGKEREFVAHINALGTRTYYADSVKGRFTISRDNSKNTVYLQMNSLRPEDTAVYYCTAQGQWRAAPVAVAAEYEFWGQGTLVTVSS

SEQ ID NO: 155 - protein, 123 aa, Artificial Sequence
  SD3097
EVQLLESGGGLVQPGGSLRLSCAASGRTYAMGWFRQAPGKEREFVAAINALGTRTYYADSVKGRFTISRDNSKNTLYLQMNSLRAEDTAVYYCTAQGQWRAAPVAVAAEYEFWGQGTLVTVSS

SEQ ID NO: 156 - protein, 123 aa, Artificial Sequence
  SD3098
EVQLLESGGGLVQPGGSLRLSCAASGRTYAMGWFRQAPGKEREFVAAINALGTRTYYADSVKGRFTISRDNSKNTLYLQMNSLRPEDTAVYYCTAQGQWRAAPVAVAAEYEFWGQGTLVTVSS

SEQ ID NO: 157 - protein, 124 aa, Artificial Sequence
  SD3013
EVQLVESGGGVVQPGGSLRLSCAASISIFDIYAMDWYRQAPGKQRELVATSFRDGSTYYADSVKGRFTISRDNSKNTLYLQMNSLRAEDTAVYLCHVSLYRDPLGVAGGMGVYWGKGALVTVSS

SEQ ID NO: 158 - protein, 124 aa, Artificial Sequence
  SD3014
EVQLVESGGGVVQPGGSLRLSCAASISIFDIYAMDWYRQAPGKQRELVAVSFRDGSTYYADSVKGRFTISRDNSKNTLYLQMNSLRAEDTAVYLCHVSLYRDPLGVAGGMGVYWGKGALVTVSS

SEQ ID NO: 159 - protein, 124 aa, Artificial Sequence
  SD3098
EVQLVESGGGVVQPGGSLRLSCAASISIFDIYAMDWYRQAPGKQRELVSVSFRDGSTYYADSVKGRFTISRDNSKNTLYLQMNSLRAEDTAVYLCHVSLYRDPLGVAGGMGVYWGKGALVTVSS

SEQ ID NO: 160 - protein, 124 aa, Artificial Sequence
  SD3016
EVQLVESGGGVVQPGGSLRLSCAASISIFDIYAMDWYRQAPGKQRELVAVSFRDGSTYYADSVKGRFTISRDNSKNTLYLQMNSLRPEDTAVYLCHVSLYRDPLGVAGGMGVYWGKGALVTVSS

SEQ ID NO: 161 - protein, 124 aa, Artificial Sequence
  SD3017
EVQLVESGGGVVQPGGSLRLSCAASISIFDIYAMHWYRQAPGKQRELVATSFRDGSTYYADSVKGRFTISRDNSKNTLYLQMNSLRAEDTAVYLCHVSLYRDPLGVAGGMGVYWGKGALVTVSS

SEQ ID NO: 162 - protein, 124 aa, Artificial Sequence
  SD3018
EVQLVESGGGVVQPGGSLRLSCAASISIFDIYAMHWYRQAPGKQRELVAVSFRDGSTYYADSVKGRFTISRDNSKNTLYLQMNSLRAEDTAVYLCHVSLYRDPLGVAGGMGVYWGKGALVTVSS

SEQ ID NO: 163 - protein, 124 aa, Artificial Sequence
  SD3019
EVQLVESGGGVVQPGGSLRLSCAASISIFDIYAMHWYRQAPGKQRELVSVSFRDGSTYYADSVKGRFTISRDNSKNTLYLQMNSLRAEDTAVYLCHVSLYRDPLGVAGGMGVYWGKGALVTVSS

SEQ ID NO: 164 - protein, 124 aa, Artificial Sequence
  SD3020
EVQLVESGGGVVQPGGSLRLSCAASISIFDIYAMHWYRQAPGKQRELVAVSFRDGSTYYADSVKGRFTISRDNSKNTLYLQMNSLRPEDTAVYLCHVSLYRDPLGVAGGMGVYWGKGALVTVSS

SEQ ID NO: 165 - protein, 124 aa, Artificial Sequence
  SD3021
EVQLVESGGGVVQPGGSLRLSCAASISIFDIYAMDWYRQAPGKQRELVAVSFRDGSTYYADSVKGRFTISRDNSKNTLYLQMNSLRPEDTAVYLCHVSLYRDPLGVAGGLGVYWGKGALVTVSS

SEQ ID NO: 166 - protein, 124 aa, Artificial Sequence
  SD3022
EVQLVESGGGVVQPGGSLRLSCAASISIFDIYAMDWYRQAPGKQRELVAVSFRDGSTYYADSVKGRFTISRDNSKNTLYLQMNSLRPEDTAVYLCHVSLYRDPLGVAGGIGVYWGKGALVTVSS

SEQ ID NO: 167 - protein, 124 aa, Artificial Sequence
  SD3029
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGLGVYWGKGALVTVSS

SEQ ID NO: 168 - protein, 124 aa, Artificial Sequence
  SD3030
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGIGVYWGKGALVTVSS

SEQ ID NO: 169 - protein, 124 aa, Artificial Sequence
  SD3031
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGVGVYWGKGALVTVSS

SEQ ID NO: 170 - protein, 124 aa, Artificial Sequence
  SD3032
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGAGVYWGKGALVTVSS

SEQ ID NO: 171 - protein, 124 aa, Artificial Sequence
  SD3033
EVQLVESGGGLVQPGGSLRLSCAVSISIFDIYAMDWYRQAPGKQRDLVATSFRDGSTNYADSVKGRFTISRDNAKNTLYLQMNSLKPEDTAVYLCHVSLYRDPLGVAGGFGVYWGKGALVTVSS

SEQ ID NO: 172 - protein, 124 aa, Artificial Sequence
  SD3089
EVQLVESGGGVVQPGGSLRLSCAASISIFDIYAMHWYRQAPGKQRELVSVSFRDGSTYYADSVKGRFTISRDNSKNTLYLQMNSLRAEDTAVYYCHVSLYRDPLGVAGGLGVYWGQGTLVTVSS

SEQ ID NO: 173 - protein, 124 aa, Artificial Sequence
  SD3078
EVQLVESGGGVVQPGGSLRLSCAASISIFDIYAMDWYRQAPGKQRELVSVSFRDGSTYYADSVKGRFTISRDNSKNTLYLQMNSLRAEDTAVYYCHVSLYRDPLGVAGGLGVYWGQGTLVTVSS

SEQ ID NO: 174 - protein, 124 aa, Artificial Sequence
  SD3080
EVQLVESGGGVVQPGGSLRLSCAASISIFDIYAMDWYRQAPGKQRELVAVSFRDGSTYYADSVKGRFTISRDNSKNTLYLQMNSLRPEDTAVYYCHVSLYRDPLGVAGGLGVYWGQGTLVTVSS

SEQ ID NO: 175 - protein, 124 aa, Artificial Sequence
  SD3079
EVQLVESGGGVVQPGGSLRLSCAASISIFDIYAMDWYRQAPGKQRELVAVSFRDGSTYYADSVKGRFTISRDNSKNTLYLQMNSLRAEDTAVYYCHVSLYRDPLGVAGGLGVYWGQGTLVTVSS

SEQ ID NO: 176 - protein, 124 aa, Artificial Sequence
  SD3119
QVQLVESGGGVVQPGGSLRLSCAASISIFDIYAMDWYRQAPGKQRELVAVSFRDGSTYYADSVKGRFTISRDNSKNTLYLQMNSLRAEDTAVYYCHVSLYRDPLGVAGGIGVYWGQGTLVTVSS

SEQ ID NO: 177 - protein, 122 aa, Artificial Sequence
  SD3041
EVQLVESGGGLVQPGGSLRLSCAASGRTLSIYSMSWFRQAPGKEREFVSAIGWNSGRTYYADSVKGRFTISRDNSKNTLYLQMNSLRAEDTAVYYCAAAKGPLRLSSQADYWGQGTQVTVSS

SEQ ID NO: 178 - protein, 122 aa, Artificial Sequence
  SD3042
EVQLVESGGGLVQPGGSLRLSCAASGRTLSIYSMSWFRQAPGKEREFVSTIGWNSGRTYYADSVKGRFTISRDNSKNTLYLQMNSLRAEDTAVYYCAAAKGPLRLSSQADYWGQGTQVTVSS

SEQ ID NO: 179 - protein, 122 aa, Artificial Sequence
  SD3043
EVQLVESGGGLVQPGGSLRLSCAASGRTLSIYSMSWFRQAPGKEREFVATIGWNSGRTYYADSVKGRFTISRDNSKNTLYLQMNSLRAEDTAVYYCAAAKGPLRLSSQADYWGQGTQVTVSS

SEQ ID NO: 180 - protein, 122 aa, Artificial Sequence
  SD3044
EVQLVESGGGLVQPGGSLRLSCAASGRTLSIYSMSWFRQAPGKEREFVSTIGWNSGRTYYADSVKGRFTISRDNARNTLYLQMNSLRAEDTAVYYCAAAKGPLRLSSQADYWGQGTQVTVSS

SEQ ID NO: 181 - protein, 122 aa, Artificial Sequence
  SD3045
EVQLVESGGGLVQAGGSLRLSCAASGRTLSIYSMSWFRQAPGKEREFVSAIGWNSGRTYYADSVKGRFTISRDNSKNTLYLQMNSLRAEDTAVYYCAAAKGPLRLSSQADYWGQGTQVTVSS

SEQ ID NO: 182 - protein, 122 aa, Artificial Sequence
  SD3046
EVQLVESGGGLVQAGGSLRLSCAASGRTLSIYSMSWFRQAPGKEREFVSTIGWNSGRTYYADSVKGRFTISRDNSKNTLYLQMNSLRAEDTAVYYCAAAKGPLRLSSQADYWGQGTQVTVSS

SEQ ID NO: 183 - protein, 122 aa, Artificial Sequence
  SD3047
EVQLVESGGGLVQAGGSLRLSCAASGRTLSIYSMSWFRQAPGKEREFVATIGWNSGRTYYADSVKGRFTISRDNSKNTLYLQMNSLRAEDTAVYYCAAAKGPLRLSSQADYWGQGTQVTVSS

SEQ ID NO: 184 - protein, 124 aa, Artificial Sequence
  SD3048
EVQLVESGGGLVQAGGSLRLSCAASGRTLSIYSMSWFRQAPGKEREFVSTIGWNSGRTYYADSVKGRFTISRDNARNTLYLQMNSLRAEDTAVYYCAAAKGPLRLSSQADYWGQGTQVTVSSSD

SEQ ID NO: 185 - protein, 122 aa, Artificial Sequence
  SD3068
EVQLVESGGGLVQPGGSLRLSCAASGRTLSIYSMGWFRQAPGKEREFVSTIGWNSGRTFYPDSLKGRFTISRDNSKNTLYLQMNSLRAEDTAVYYCAAAKGPLRLSSQADYWGQGTLVTVSS

SEQ ID NO: 186 - protein, 122 aa, Artificial Sequence
  SD3067
EVQLVESGGGLVQPGGSLRLSCAASGRTLSIYSMGWFRQAPGKEREFVATIGWNSGRTFYPDSLKGRFTISRDNSKNTLYLQMNSLRAEDTAVYYCAAAKGPLRLSSQADYWGQGTLVTVSS

SEQ ID NO: 187 - protein, 122 aa, Artificial Sequence
  SD3099
EVQLVESGGGLVQPGGSLRLSCAASGRTLSIYSMGWFRQAPGKEREFVATIGWNSGRTFYPDSVKGRFTISRDNSKNTLYLQMNSLRAEDTAVYYCAAAKGPLRLSSQADYWGQGTLVTVSS

SEQ ID NO: 188 - protein, 129 aa, Artificial Sequence
  SD3005
EVQLLESGGGLVQPGGSLRLSCAASGFTLENKAMSWFRQAPGKEREGVSCISKSGSWTYYADSVKGRFTISRDNSKNTLYLQMNSLRAEDTAVYYCATTTAGGGLCWDGTTFSRLASSWGQGTQVTVSS

SEQ ID NO: 189 - protein, 129 aa, Artificial Sequence
  SD3006
EVQLLESGGGLVQPGGSLRLSCAASGFTLENKAIGWFRQAPGKEREGVSCISKSGSWTYYADSVKGRFTISRDNSKNTLYLQMNSLRAEDTAVYYCATTTAGGGLCWDGTTFSRLASSWGQGTQVTVSS

SEQ ID NO: 190 - protein, 129 aa, Artificial Sequence
  SD3007
EVQLLESGGGLVQPGGSLRLSCAASGFTLENKAIGWFRQAPGKEREGVSCISKSGSWTYYADSVKGRFTISRDNSKNTVYLQMNSLRAEDTAVYYCATTTAGGGLCWDGTTFSRLASSWGQGTQVTVSS

SEQ ID NO: 191 - protein, 129 aa, Artificial Sequence
  SD3008
EVQLLESGGGLVQPGGSLRLSCAASGFTLENKAIGWFRQAPGKEREGVSCISKSGSWTYYADSVKGRFTISRDNSKNTVYLQMNSLRPEDTAVYYCATTTAGGGLCWDGTTFSRLASSWGQGTQVTVSS

SEQ ID NO: 192 - protein, 129 aa, Artificial Sequence
  SD3009
EVQLLESGGGLVQPGGSLRLSCAASGFTLENKAMSWFRQAPGKEREGVLCISKSGSWTYYADSVKGRFTISRDNSKNTLYLQMNSLRAEDTAVYYCATTTAGGGLCWDGTTFSRLASSWGQGTQVTVSS

SEQ ID NO: 193 - protein, 129 aa, Artificial Sequence
  SD3010
EVQLLESGGGLVQPGGSLRLSCAASGFTLENKAIGWFRQAPGKEREGVLCISKSGSWTYYADSVKGRFTISRDNSKNTLYLQMNSLRAEDTAVYYCATTTAGGGLCWDGTTFSRLASSWGQGTQVTVSS

SEQ ID NO: 194 - protein, 129 aa, Artificial Sequence
  SD3011
EVQLLESGGGLVQPGGSLRLSCAASGFTLENKAIGWFRQAPGKEREGVLCISKSGSWTYYADSVKGRFTISRDNSKNTVYLQMNSLRAEDTAVYYCATTTAGGGLCWDGTTFSRLASSWGQGTQVTVSS

SEQ ID NO: 195 - protein, 129 aa, Artificial Sequence
  SD3012
EVQLLESGGGLVQPGGSLRLSCAASGFTLENKAIGWFRQAPGKEREGVLCISKSGSWTYYADSVKGRFTISRDNSKNTVYLQMNSLRPEDTAVYYCATTTAGGGLCWDGTTFSRLASSWGQGTQVTVSS

SEQ ID NO: 196 - protein, 129 aa, Artificial Sequence
  SD3088
EVQLLESGGGLVQPGGSLRLSCAASGFTLENKAIGWFRQAPGKEREGVLCISKSGSWTYYADSVKGRFTISRDNSKNTLYLQMNSLRAEDTAVYYCATTTAGGGLCWDGTTFSRLASSWGQGTLVTVSS

SEQ ID NO: 197 - protein, 129 aa, Artificial Sequence
  SD3087
EVQLLESGGGLVQPGGSLRLSCAASGFTLENKAIGWFRQAPGKEREGVLCISKSGSWTYYADSVKGRFTISRDNSKNTVYLQMNSLRPEDTAVYYCATTTAGGGLCWDGTTFSRLASSWGQGTLVTVSS

SEQ ID NO: 198 - protein, 116 aa, Artificial Sequence
  SD3001
EVQLVESGGGLVQPGGSLRLSCAASGFTFSTSWMSWLRQAPGKGLEWVSVINTDGGTYYADSVKGRFTISRDNSKNTLYLQMNSLRAEDTAVYYCAKDWGGPEPTRGQGTQVTVSS

SEQ ID NO: 199 - protein, 116 aa, Artificial Sequence
  SD3002
EVQLVESGGGLVQPGGSLRLSCAASGFTFSTSWMYWLRQAPGKGLEWVSVINTDGGTYYADSVKGRFTISRDNSKNTLYLQMNSLRAEDTAVYYCAKDWGGPEPTRGQGTQVTVSS

SEQ ID NO: 200 - protein, 116 aa, Artificial Sequence
  SD3003
EVQLVESGGGLVQPGGSLRLSCAASGFTFSTSWMSWLRQAPGKGLEWVSVINTDGGTYYADSVKGRFTISRDNSKDTLYLQMNSLRAEDTAVYYCAKDWGGPEPTRGQGTQVTVSS

SEQ ID NO: 201 - protein, 116 aa, Artificial Sequence
  SD3004
EVQLVESGGGLVQPGGSLRLSCAASGFTFSTSWMYWLRQAPGKGLEWVSVINTDGGTYYADSVKGRFTISRDNSKDTLYLQMNSLRAEDTAVYYCAKDWGGPEPTRGQGTQVTVSS

SEQ ID NO: 202 - protein, 116 aa, Artificial Sequence
  SD3086
EVQLVESGGGLVQPGGSLRLSCAASGFTFSTSWMYWVRQAPGKGLEWVSVINTDGGTYYADSVKGRFTISRDNSKNTLYLQMNSLRAEDTAVYYCAKDWGGPEPTRGQGTLVTVSS

SEQ ID NO: 203 - protein, 116 aa, Artificial Sequence
  SD3085
EVQLVESGGGLVQPGGSLRLSCAASGFTFSTSWMYWLRQAPGKGLEWVSVINTDGGTYYADSVKGRFTISRDNSKNTLYLQMNSLRAEDTAVYYCAKDWGGPEPTRGQGTLVTVSS

SEQ ID NO: 204 - protein, 127 aa, Artificial Sequence
  SD3049
EVQLVESGGGLVQPGGSLRLSCAASGLSLDTYAMSWFRQAPGKEREGVSCISSGHGMTYYADSVKGRFTISRDNSKNTLYLQMNSLQPEDTARYYCATESRYYCSDNWPAPQRYIYWGQGTQVTVSS

SEQ ID NO: 205 - protein, 127 aa, Artificial Sequence
  SEQ 3050
EVQLVESGGGLVQPGGSLRLSCAASGLSLDTYAMSWFRQAPGKEREGITCISSGHGMTYYADSVKGRFTISRDNSKNTLYLQMNSLQPEDTARYYCATESRYYCSDNWPAPQRYIYWGQGTQVTVSS

SEQ ID NO: 206 - protein, 127 aa, Artificial Sequence
  SD3051
EVQLVESGGGLVQPGGSLRLSCAASGLSLDTYAMSWFRQAPGKEREGVSCISSGHGITYYADSVKGRFTISRDNSKNTLYLQMNSLQPEDTARYYCATESRYYCSDNWPAPQRYIYWGQGTQVTVSS

SEQ ID NO: 207 - protein, 127 aa, Artificial Sequence
  SD3052
EVQLVESGGGLVQPGGSLRLSCAASGLSLDTYAMSWFRQAPGKEREGVSCISSGHGLTYYADSVKGRFTISRDNSKNTLYLQMNSLQPEDTARYYCATESRYYCSDNWPAPQRYIYWGQGTQVTVSS

SEQ ID NO: 208 - protein, 127 aa, Artificial Sequence
  SD3053
EVQLVESGGGLVQPGGSLRLSCAASGLSLDTYAMSWFRQAPGKEREGVSCISSGHGFTYYADSVKGRFTISRDNSKNTLYLQMNSLQPEDTARYYCATESRYYCSDNWPAPQRYIYWGQGTQVTVSS

SEQ ID NO: 209 - protein, 127 aa, Artificial Sequence
  SD3054
EVQLVESGGGLVQPGGSLRLSCAASGLSLDTYAMSWFRQAPGKEREGITCISSGHGITYYADSVKGRFTISRDNSKNTLYLQMNSLQPEDTARYYCATESRYYCSDNWPAPQRYIYWGQGTQVTVSS

SEQ ID NO: 210 - protein, 127 aa, Artificial Sequence
  SD3055
EVQLVESGGGLVQPGGSLRLSCAASGLSLDTYAMSWFRQAPGKEREGITCISSGHGLTYYADSVKGRFTISRDNSKNTLYLQMNSLQPEDTARYYCATESRYYCSDNWPAPQRYIYWGQGTQVTVSS

SEQ ID NO: 211 - protein, 127 aa, Artificial Sequence
  SD3056
EVQLVESGGGLVQPGGSLRLSCAASGLSLDTYAMSWFRQAPGKEREGITCISSGHGFTYYADSVKGRFTISRDNSKNTLYLQMNSLQPEDTARYYCATESRYYCSDNWPAPQRYIYWGQGTQVTVSS

SEQ ID NO: 212 - protein, 127 aa, Artificial Sequence
  SD3069
EVQLVESGGGLVQPGGSLRLSCAISGLSLDTYAVGWFRQAPGKEREGITCISSGHGMTYYADSVKGRFTVSTDNSKNTLYLQMNSLRAEDTAVYYCATESRYYCSDNWPAPQRYIYWGQGTLVTVSS

SEQ ID NO: 213 - protein, 127 aa, Artificial Sequence
  SD3070
EVQLVESGGGLVQPGGSLRLSCAISGLSLDTYAVGWFRQAPGKEREGITCISSGHGITYYADSVKGRFTVSTDNSKNTLYLQMNSLRAEDTAVYYCATESRYYCSDNWPAPQRYIYWGQGTLVTVSS

SEQ ID NO: 214 - protein, 127 aa, Artificial Sequence
  SD3071
EVQLVESGGGLVQPGGSLRLSCAISGLSLDTYAVGWFRQAPGKEREGITCISSGHGLTYYADSVKGRFTVSTDNSKNTLYLQMNSLRAEDTAVYYCATESRYYCSDNWPAPQRYIYWGQGTLVTVSS

SEQ ID NO: 215 - protein, 127 aa, Artificial Sequence
  SD3072
EVQLVESGGGLVQPGGSLRLSCAASGLSLDTYAVGWFRQAPGKEREGITCISSGHGMTYYADSVKGRFTVSTDNSKNTLYLQMNSLRAEDTAVYYCATESRYYCSDNWPAPQRYIYWGQGTLVTVSS

SEQ ID NO: 216 - protein, 127 aa, Artificial Sequence
  SD3073
EVQLVESGGGLVQPGGSLRLSCAISGLSLDTYAVGWFRQAPGKEREGVSCISSGHGMTYYADSVKGRFTVSTDNSKNTLYLQMNSLRAEDTAVYYCATESRYYCSDNWPAPQRYIYWGQGTLVTVSS

SEQ ID NO: 217 - protein, 127 aa, Artificial Sequence
  SD3074
EVQLVESGGGLVQPGGSLRLSCAISGLSLDTYAVGWFRQAPGKEREGITCISSGHGMTYYADSVKGRFTISTDNSKNTLYLQMNSLRAEDTAVYYCATESRYYCSDNWPAPQRYIYWGQGTLVTVSS

SEQ ID NO: 218 - protein, 127 aa, Artificial Sequence
  SD3075
EVQLVESGGGLVQPGGSLRLSCAASGLSLDTYAVGWFRQAPGKEREGVSCISSGHGITYYADSVKGRFTISTDNSKNTLYLQMNSLRAEDTAVYYCATESRYYCSDNWPAPQRYIYWGQGTLVTVSS

SEQ ID NO: 219 - protein, 127 aa, Artificial Sequence
  SD3076
EVQLVESGGGLVQPGGSLRLSCAASGLSLDTYAVGWFRQAPGKEREGVSCISSGHGLTYYADSVKGRFTISTDNSKNTLYLQMNSLRAEDTAVYYCATESRYYCSDNWPAPQRYIYWGQGTLVTVSS

SEQ ID NO: 220 - protein, 127 aa, Artificial Sequence
  SD3092
EVQLVESGGGLVQPGGSLRLSCAISGLSLDTYAVGWFRQAPGKEREGVSCISSGHGMTYYADSVKGRFTISTDNSKNTLYLQMNSLRAEDTAVYYCATESRYYCSDNWPAPQRYIYWGQGTLVTVSS

SEQ ID NO: 221 - protein, 127 aa, Artificial Sequence
  SD3093
EVQLVESGGGLVQPGGSLRLSCAISGLSLDTYAVGWFRQAPGKEREGVSCISSGHGMTYYADSVKGRFTISTDNSKNTVYLQMNSLRAEDTAVYYCATESRYYCSDNWPAPQRYIYWGQGTLVTVSS

SEQ ID NO: 222 - protein, 127 aa, Artificial Sequence
  SD3100
EVQLVESGGGLVQPGGSLRLSCAISGLSLDTYAVGWFRQAPGKEREGVSCISSGHGATYYADSVKGRFTISTDNSKNTLYLQMNSLRAEDTAVYYCATESRYYCSDNWPAPQRYIYWGQGTLVTVSS

SEQ ID NO: 223 - protein, 127 aa, Artificial Sequence
  SD3101
EVQLVESGGGLVQPGGSLRLSCAISGLSLDTYAVGWFRQAPGKEREGVSCISSGHGSTYYADSVKGRFTISTDNSKNTLYLQMNSLRAEDTAVYYCATESRYYCSDNWPAPQRYIYWGQGTLVTVSS

SEQ ID NO: 224 - protein, 127 aa, Artificial Sequence
  SD3102
EVQLVESGGGLVQPGGSLRLSCAISGLSLDTYAVGWFRQAPGKEREGVSCISSGHGQTYYADSVKGRFTISTDNSKNTLYLQMNSLRAEDTAVYYCATESRYYCSDNWPAPQRYIYWGQGTLVTVSS

SEQ ID NO: 225 - protein, 127 aa, Artificial Sequence
  SD3103
EVQLVESGGGLVQPGGSLRLSCAISGLSLDTYAVGWFRQAPGKEREGVSCISSGHGDTYYADSVKGRFTISTDNSKNTLYLQMNSLRAEDTAVYYCATESRYYCSDNWPAPQRYIYWGQGTLVTVSS

SEQ ID NO: 226 - protein, 127 aa, Artificial Sequence
  SD3104
EVQLVESGGGLVQPGGSLRLSCAISGLSLDTYAVGWFRQAPGKEREGVSCISSGHGNTYYADSVKGRFTISTDNSKNTLYLQMNSLRAEDTAVYYCATESRYYCSDNWPAPQRYIYWGQGTLVTVSS

SEQ ID NO: 227 - protein, 6 aa, Artificial Sequence
  CDR1 SD 1018
QTYHMG

SEQ ID NO: 228 - protein, 8 aa, Artificial Sequence
  CDR2 SD1018
AVTWSGAV

SEQ ID NO: 229 - protein, 19 aa, Artificial Sequence
  CDR3 SD1018
AATRSMAPIIQLSPGSYDY

SEQ ID NO: 230 - protein, 9 aa, Artificial Sequence
  CDR1 SD1071
FTYSTYWMY

SEQ ID NO: 231 - protein, 8 aa, Artificial Sequence
  CDR2 SD1071
STNAAGTV

SEQ ID NO: 232 - protein, 17 aa, Artificial Sequence
  CDR3 SD1071
ASKDGLIVAATLDDYDY

SEQ ID NO: 233 - protein, 9 aa, Artificial Sequence
  CDR1 SD1035
SAVSISRMA

SEQ ID NO: 234 - protein, 7 aa, Artificial Sequence
  CDR2 SD1035
DIFSGGG

SEQ ID NO: 235 - protein, 16 aa, Artificial Sequence
  CDR3 SD1035
SARSAVAAIHWDQYDY

SEQ ID NO: 236 - protein, 9 aa, Artificial Sequence
  CDR1 SD1016
MFFGIAAMG

SEQ ID NO: 237 - protein, 7 aa, Artificial Sequence
  CDR2 SD1016
NITSDFS

SEQ ID NO: 238 - protein, 14 aa, Artificial Sequence
  CDR3 SD1016
AADSLGTGWRHYYY

SEQ ID NO: 239 - protein, 9 aa, Artificial Sequence
  CDR1 SD1072
RTFSMYATG

SEQ ID NO: 240 - protein, 8 aa, Artificial Sequence
  CDR2 SD1072
AINSSGDK

SEQ ID NO: 241 - protein, 17 aa, Artificial Sequence
  CDR3 SD1072
AAARTLAVVTIPGGYEY

SEQ ID NO: 242 - protein, 9 aa, Artificial Sequence
  CDR1 SD1074
NFDAIGAMG

SEQ ID NO: 243 - protein, 7 aa, Artificial Sequence
  CDR2 SD1074
EITSDGS

SEQ ID NO: 244 - protein, 14 aa, Artificial Sequence
  CDR3 SD1074
KADISIYGLTNFPY

SEQ ID NO: 245 - protein, 9 aa, Artificial Sequence
  CDR1 SD1076
FAFSIATMG

SEQ ID NO: 246 - protein, 7 aa, Artificial Sequence
  CDR2 SD1076
DITSGGS

SEQ ID NO: 247 - protein, 14 aa, Artificial Sequence
  CDR3 SD1076
NADSLATGWRQYSY

SEQ ID NO: 248 - protein, 6 aa, Artificial Sequence
  CDR1 SD1017
RTYAMA

SEQ ID NO: 249 - protein, 8 aa, Artificial Sequence
  CDR2 SD1017
HINALGTR

SEQ ID NO: 250 - protein, 19 aa, Artificial Sequence
  CDR3 SD1017
AAGGQWRAAPVADAAQYDF

SEQ ID NO: 251 - protein, 6 aa, Artificial Sequence
  CDR1 SD1025
RTYAMA

SEQ ID NO: 252 - protein, 8 aa, Artificial Sequence
  CDR2 SD1025
HINALGTR

SEQ ID NO: 253 - protein, 19 aa, Artificial Sequence
  CDR3 SD1025
AAGGQWRAAPVADAAQYDF

SEQ ID NO: 254 - protein, 9 aa, Artificial Sequence
  CDR1 SD1070
RTFSIYSMG

SEQ ID NO: 255 - protein, 8 aa, Artificial Sequence
  CDR2 SD1070
TIGWNSGR

SEQ ID NO: 256 - protein, 15 aa, Artificial Sequence
  CDR3 SD1070
AAAKGPLRLSSQADY

SEQ ID NO: 257 - protein, 9 aa, Artificial Sequence
  CDR1 SD2020
GAFNRQLVA

SEQ ID NO: 258 - protein, 8 aa, Artificial Sequence
  CDR2 SD2020
TVTTSGGS

SEQ ID NO: 259 - protein, 19 aa, Artificial Sequence
  CDR3 SD2020
AARDSFTVAPYYPPESYAY

SEQ ID NO: 260 - protein, 9 aa, Artificial Sequence
  CDR1 AD1069
PTFGMSAMG

SEQ ID NO: 261 - protein, 7 aa, Artificial Sequence
  CDR2 SD1069
AISGLGN

SEQ ID NO: 262 - protein, 19 aa, Artificial Sequence
  CDR3 SD1069
AQRKVYHVQGGDRPQAYDY

SEQ ID NO: 263 - protein, 9 aa, Artificial Sequence
  CDR1 1046
RTLSIYSMG

SEQ ID NO: 264 - protein, 8 aa, Artificial Sequence
  CDR2 SD1046
TIGWNSGR

SEQ ID NO: 265 - protein, 15 aa, Artificial Sequence
  CDR3 SD1046
AAAKGPLRLSSQADY

SEQ ID NO: 266 - protein, 9 aa, Artificial Sequence
  CDR1 SD1048
RTSSMYSIG

SEQ ID NO: 267 - protein, 8 aa, Artificial Sequence
  CDR2 SD1048
VIGWYSGR

SEQ ID NO: 268 - protein, 15 aa, Artificial Sequence
  CDR3 SD1048
AAANGPLRLSNQADY

SEQ ID NO: 269 - protein, 9 aa, Artificial Sequence
  CDR1 SD1049
RTLSLYSVG

SEQ ID NO: 270 - protein, 8 aa, Artificial Sequence
  CDR2 SD1049
TIGWNSGR

SEQ ID NO: 271 - protein, 15 aa, Artificial Sequence
  CDR3 SD1049
AAAKGPLRLSNQADY

SEQ ID NO: 272 - protein, 9 aa, Artificial Sequence
  CDR1 SD1027
GTFSLYHMG

SEQ ID NO: 273 - protein, 8 aa, Artificial Sequence
  CDR2 SD1027
AISGSGGN

SEQ ID NO: 274 - protein, 17 aa, Artificial Sequence
  CDR3 SD1027
AAMKWPGILRDANAYDY

SEQ ID NO: 275 - protein, 6 aa, Artificial Sequence
  CDR1 SD1036
RTYAMG

SEQ ID NO: 276 - protein, 8 aa, Artificial Sequence
  CDR2 SD1036
HINALGTR

SEQ ID NO: 277 - protein, 19 aa, Artificial Sequence
  CDR3 SD1036
TAQGQWRAAPVAVAAEYEF

SEQ ID NO: 278 - protein, 6 aa, Artificial Sequence
  CDR1 SD1014
RTYAMA

SEQ ID NO: 279 - protein, 8 aa, Artificial Sequence
  CDR2 SD1014
HINALGTR

SEQ ID NO: 280 - protein, 19 aa, Artificial Sequence
  CDR3 SD1014
AAGGQWRAAPVADAAQYDF

SEQ ID NO: 281 - protein, 6 aa, Artificial Sequence
  CDR1 SD1047
RTYAMA

SEQ ID NO: 282 - protein, 8 aa, Artificial Sequence
  CDR2 SD1047
HINALGTR

SEQ ID NO: 283 - protein, 19 aa, Artificial Sequence
  CDR3 SD1047
VAGGQWRAAPVAAAESYDF

SEQ ID NO: 284 - protein, 9 aa, Artificial Sequence
  CDR1 SD1038
SIFDIYAMD

SEQ ID NO: 285 - protein, 7 aa, Artificial Sequence
  CDR2 SD1038
TSFRDGS

SEQ ID NO: 286 - protein, 18 aa, Artificial Sequence
  CDR3 SD1038
HVSLYRDPLGVAGGMGVY

SEQ ID NO: 287 - protein, 9 aa, Artificial Sequence
  CDR1 SD1045
SSFSINVMG

SEQ ID NO: 288 - protein, 7 aa, Artificial Sequence
  CDR2 SD1044
TITYGGS

SEQ ID NO: 289 - protein, 9 aa, Artificial Sequence
  CDR3 SD1045
NSRLAQINY

SEQ ID NO: 290 - protein, 9 aa, Artificial Sequence
  CDR1 SD1073
SAFSIAAMG

SEQ ID NO: 291 - protein, 7 aa, Artificial Sequence
  CDR2 SD1073
TITTGGS

SEQ ID NO: 292 - protein, 16 aa, Artificial Sequence
  CDR3 SD1073
TAKSVVAETFGDLYNY

SEQ ID NO: 293 - protein, 11 aa, Artificial Sequence
  CDR1 SD1034
TIFGIRVNTMG

SEQ ID NO: 294 - protein, 749 aa, Artificial Sequence
  FM1W3 (SEQ ID NO: 293)
QVQLVESGGGVVQPGGSLRLSCAASISIFDIYAMDWYRQAPGKQRELVAVSFRDGSTYYADSVKGRFTISRDNSKNTLYLQMNSLRAEDTAVYYCHVSLYRDPLGVAGGIGVYWGQGTLVTVSSGGGGSGGGGSEVQLLESGGGLVQPGGSLRLSCAASGRTYAMGWFRQAPGKEREFVAAINALGTRTYYADSVKGRFTISRDNSKNTLYLQMNSLRAEDTAVYYCTAQGQWRAAPVAVAAEYEFWGQGTLVTVSSGGGGSGGGGSEVQLLESGGGLVQPGGSLRLSCAASGFTLENKAIGWFRQAPGKEREGVLCISKSGSWTYYADSVKGRFTISRDNSKNTVYLQMNSLRPEDTAVYYCATTTAGGGLCWDGTTFSRLASSWGQGTLVTVSSGGGGSGGGGSEVQLVESGGGLVQPGGSLRLSCAASGFTFSTSWMYWLRQAPGKGLEWVSVINTDGGTYYADSVKGRFTISRDNSKNTLYLQMNSLRAEDTAVYYCAKDWGGPEPTRGQGTLVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 295 - protein, 749 aa, Artificial Sequence
  FM1W4 (SEQ ID NO: 294)
EVQLLESGGGLVQPGGSLRLSCAASGFTLENKAIGWFRQAPGKEREGVLCISKSGSWTYYADSVKGRFTISRDNSKNTVYLQMNSLRPEDTAVYYCATTTAGGGLCWDGTTFSRLASSWGQGTLVTVSSGGGGSGGGGSQVQLVESGGGVVQPGGSLRLSCAASISIFDIYAMDWYRQAPGKQRELVAVSFRDGSTYYADSVKGRFTISRDNSKNTLYLQMNSLRAEDTAVYYCHVSLYRDPLGVAGGIGVYWGQGTLVTVSSGGGGSGGGGSEVQLVESGGGLVQPGGSLRLSCAASGFTFSTSWMYWLRQAPGKGLEWVSVINTDGGTYYADSVKGRFTISRDNSKNTLYLQMNSLRAEDTAVYYCAKDWGGPEPTRGQGTLVTVSSGGGGSGGGGSEVQLLESGGGLVQPGGSLRLSCAASGRTYAMGWFRQAPGKEREFVAAINALGTRTYYADSVKGRFTISRDNSKNTLYLQMNSLRAEDTAVYYCTAQGQWRAAPVAVAAEYEFWGQGTLVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 296 - protein, 748 aa, Artificial Sequence
  FW1W5 (SEQ ID NO: 295)
QVQLVESGGGVVQPGGSLRLSCAASISIFDIYAMDWYRQAPGKQRELVAVSFRDGSTYYADSVKGRFTISRDNSKNTLYLQMNSLRAEDTAVYYCHVSLYRDPLGVAGGIGVYWGQGTLVTVSSGGGGSGGGGSEVQLVESGGGLVQPGGSLRLSCAASGRTLSIYSMGWFRQAPGKEREFVATIGWNSGRTFYPDSVKGRFTISRDNSKNTLYLQMNSLRAEDTAVYYCAAAKGPLRLSSQADYWGQGTLVTVSSGGGGSGGGGSEVQLLESGGGLVQPGGSLRLSCAASGFTLENKAIGWFRQAPGKEREGVLCISKSGSWTYYADSVKGRFTISRDNSKNTVYLQMNSLRPEDTAVYYCATTTAGGGLCWDGTTFSRLASSWGQGTLVTVSSGGGGSGGGGSEVQLVESGGGLVQPGGSLRLSCAASGFTFSTSWMYWLRQAPGKGLEWVSVINTDGGTYYADSVKGRFTISRDNSKNTLYLQMNSLRAEDTAVYYCAKDWGGPEPTRGQGTLVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 297 - protein, 748 aa, Artificial Sequence
  FM1W6 (SEQ ID NO: 296)
EVQLVESGGGLVQPGGSLRLSCAASGRTLSIYSMGWFRQAPGKEREFVATIGWNSGRTFYPDSVKGRFTISRDNSKNTLYLQMNSLRAEDTAVYYCAAAKGPLRLSSQADYWGQGTLVTVSSGGGGSGGGGSQVQLVESGGGVVQPGGSLRLSCAASISIFDIYAMDWYRQAPGKQRELVAVSFRDGSTYYADSVKGRFTISRDNSKNTLYLQMNSLRAEDTAVYYCHVSLYRDPLGVAGGIGVYWGQGTLVTVSSGGGGSGGGGSEVQLVESGGGLVQPGGSLRLSCAASGFTFSTSWMYWLRQAPGKGLEWVSVINTDGGTYYADSVKGRFTISRDNSKNTLYLQMNSLRAEDTAVYYCAKDWGGPEPTRGQGTLVTVSSGGGGSGGGGSEVQLLESGGGLVQPGGSLRLSCAASGFTLENKAIGWFRQAPGKEREGVLCISKSGSWTYYADSVKGRFTISRDNSKNTVYLQMNSLRPEDTAVYYCATTTAGGGLCWDGTTFSRLASSWGQGTLVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 298 - protein, 746 aa, Artificial Sequence
  FM1W7 (SEQ ID NO: 297)
QVQLVESGGGVVQPGGSLRLSCAASISIFDIYAMDWYRQAPGKQRELVAVSFRDGSTYYADSVKGRFTISRDNSKNTLYLQMNSLRAEDTAVYYCHVSLYRDPLGVAGGIGVYWGQGTLVTVSSGGGGSGGGGSEVQLVESGGGLVQPGGSLRLSCAASGRTLSIYSMGWFRQAPGKEREFVATIGWNSGRTFYPDSVKGRFTISRDNSKNTLYLQMNSLRAEDTAVYYCAAAKGPLRLSSQADYWGQGTLVTVSSGGGGSGGGGSEVQLVESGGGLVQPGGSLRLSCAISGLSLDTYAVGWFRQAPGKEREGVSCISSGHGMTYYADSVKGRFTISTDNSKNTVYLQMNSLRAEDTAVYYCATESRYYCSDNWPAPQRYIYWGQGTLVTVSSGGGGSGGGGSEVQLVESGGGLVQPGGSLRLSCAASGFTFSTSWMYWLRQAPGKGLEWVSVINTDGGTYYADSVKGRFTISRDNSKNTLYLQMNSLRAEDTAVYYCAKDWGGPEPTRGQGTLVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 299 - protein, 746 aa, Artificial Sequence
  FM1W8 (SEQ ID NO: 298)
EVQLVESGGGLVQPGGSLRLSCAISGLSLDTYAVGWFRQAPGKEREGVSCISSGHGMTYYADSVKGRFTISTDNSKNTVYLQMNSLRAEDTAVYYCATESRYYCSDNWPAPQRYIYWGQGTLVTVSSGGGGSGGGGSEVQLVESGGGLVQPGGSLRLSCAASGFTFSTSWMYWLRQAPGKGLEWVSVINTDGGTYYADSVKGRFTISRDNSKNTLYLQMNSLRAEDTAVYYCAKDWGGPEPTRGQGTLVTVSSGGGGSGGGGSQVQLVESGGGVVQPGGSLRLSCAASISIFDIYAMDWYRQAPGKQRELVAVSFRDGSTYYADSVKGRFTISRDNSKNTLYLQMNSLRAEDTAVYYCHVSLYRDPLGVAGGIGVYWGQGTLVTVSSGGGGSGGGGSEVQLVESGGGLVQPGGSLRLSCAASGRTLSIYSMGWFRQAPGKEREFVATIGWNSGRTFYPDSVKGRFTISRDNSKNTLYLQMNSLRAEDTAVYYCAAAKGPLRLSSQADYWGQGTLVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 300 - protein, 484 aa, Artificial Sequence
  FM1B67.1 (SEQ ID NO: 299)
QVQLVESGGGVVQPGGSLRLSCAASISIFDIYAMDWYRQAPGKQRELVAVSFRDGSTYYADSVKGRFTISRDNSKNTLYLQMNSLRAEDTAVYYCHVSLYRDPLGVAGGIGVYWGQGTLVTVSSGGGGSGGGGSEVQLLESGGGLVQPGGSLRLSCAASGRTYAMGWFRQAPGKEREFVAAINALGTRTYYADSVKGRFTISRDNSKNTLYLQMNSLRAEDTAVYYCTAQGQWRAAPVAVAAEYEFWGQGTLVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSRLTVDKSRWQQGNVFSCSVMHEALHNHYTQKSLSLSPGK

SEQ ID NO: 301 - protein, 482 aa, Artificial Sequence
  FM1B67.1 (SEQ ID NO: 300)
EVQLVESGGGLVQPGGSLRLSCAASGFTFSTSWMYWLRQAPGKGLEWVSVINTDGGTYYADSVKGRFTISRDNSKNTLYLQMNSLRAEDTAVYYCAKDWGGPEPTRGQGTLVTVSSGGGGSGGGGSEVQLLESGGGLVQPGGSLRLSCAASGFTLENKAIGWFRQAPGKEREGVLCISKSGSWTYYADSVKGRFTISRDNSKNTVYLQMNSLRPEDTAVYYCATTTAGGGLCWDGTTFSRLASSWGQGTLVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 302 - protein, 484 aa, Artificial Sequence; identical to SEQ ID NO: 300
  FM1B68.1 (SEQ ID NO: 301)

SEQ ID NO: 303 - protein, 482 aa, Artificial Sequence
  FM1B68.1 (SEQ ID NO: 302)
EVQLLESGGGLVQPGGSLRLSCAASGFTLENKAIGWFRQAPGKEREGVLCISKSGSWTYYADSVKGRFTISRDNSKNTVYLQMNSLRPEDTAVYYCATTTAGGGLCWDGTTFSRLASSWGQGTLVTVSSGGGGSGGGGSEVQLVESGGGLVQPGGSLRLSCAASGFTFSTSWMYWLRQAPGKGLEWVSVINTDGGTYYADSVKGRFTISRDNSKNTLYLQMNSLRAEDTAVYYCAKDWGGPEPTRGQGTLVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 304 - protein, 484 aa, Artificial Sequence; identical to SEQ ID NO: 300
  FM1B69.1 (SEQ ID NO: 303)

SEQ ID NO: 305 - protein, 480 aa, Artificial Sequence
  FM1B69.1 (SEQ ID NO: 305)
EVQLVESGGGLVQPGGSLRLSCAISGLSLDTYAVGWFRQAPGKEREGVSCISSGHGMTYYADSVKGRFTISTDNSKNTVYLQMNSLRAEDTAVYYCATESRYYCSDNWPAPQRYIYWGQGTLVTVSSGGGGSGGGGSEVQLVESGGGLVQPGGSLRLSCAASGFTFSTSWMYWLRQAPGKGLEWVSVINTDGGTYYADSVKGRFTISRDNSKNTLYLQMNSLRAEDTAVYYCAKDWGGPEPTRGQGTLVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 306 - protein, 483 aa, Artificial Sequence
  FM1B70.1 (SEQ ID NO: 306)
QVQLVESGGGVVQPGGSLRLSCAASISIFDIYAMDWYRQAPGKQRELVAVSFRDGSTYYADSVKGRFTISRDNSKNTLYLQMNSLRAEDTAVYYCHVSLYRDPLGVAGGIGVYWGQGTLVTVSSGGGGSGGGGSEVQLVESGGGLVQPGGSLRLSCAASGRTLSIYSMGWFRQAPGKEREFVATIGWNSGRTFYPDSVKGRFTISRDNSKNTLYLQMNSLRAEDTAVYYCAAAKGPLRLSSQADYWGQGTLVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSRLTVDKSRWQQGNVFSCSVMHEALHNHYTQKSLSLSPGK

SEQ ID NO: 307 - protein, 482 aa, Artificial Sequence; identical to SEQ ID NO: 301
  FM1B70.1 (SEQ ID NO: 307)

SEQ ID NO: 308 - protein, 483 aa, Artificial Sequence; identical to SEQ ID NO: 306
  FM1B71.1 (SEQ ID NO: 308)

SEQ ID NO: 309 - protein, 482 aa, Artificial Sequence; identical to SEQ ID NO: 303
  FM1B71.1 (SEQ ID NO: 309)

SEQ ID NO: 310 - protein, 483 aa, Artificial Sequence; identical to SEQ ID NO: 306
  FM72.1 (SEQ ID NO: 310)

SEQ ID NO: 311 - protein, 480 aa, Artificial Sequence; identical to SEQ ID NO: 305
  FM1B72.1 (SEQ ID NO: 311)

SEQ ID NO: 312 - protein, 484 aa, Artificial Sequence
  FM1B73.1 (SEQ ID NO: 312)
EVQLLESGGGLVQPGGSLRLSCAASGRTYAMGWFRQAPGKEREFVAAINALGTRTYYADSVKGRFTISRDNSKNTLYLQMNSLRAEDTAVYYCTAQGQWRAAPVAVAAEYEFWGQGTLVTVSSGGGGSGGGGSQVQLVESGGGVVQPGGSLRLSCAASISIFDIYAMDWYRQAPGKQRELVAVSFRDGSTYYADSVKGRFTISRDNSKNTLYLQMNSLRAEDTAVYYCHVSLYRDPLGVAGGIGVYWGQGTLVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSRLTVDKSRWQQGNVFSCSVMHEALHNHYTQKSLSLSPGK

SEQ ID NO: 313 - protein, 482 aa, Artificial Sequence; identical to SEQ ID NO: 301
  FM1B73.1 (SEQ ID NO: 313)

SEQ ID NO: 314 - protein, 484 aa, Artificial Sequence; identical to SEQ ID NO: 312
  FM1B74.1 (SEQ ID NO: 314)

SEQ ID NO: 315 - protein, 482 aa, Artificial Sequence; identical to SEQ ID NO: 303
  FM1B74.1 (SEQ ID NO: 315)

SEQ ID NO: 316 - protein, 484 aa, Artificial Sequence; identical to SEQ ID NO: 312
  FM1B75.1 (SEQ ID NO: 316)

SEQ ID NO: 317 - protein, 480 aa, Artificial Sequence; identical to SEQ ID NO: 305
  FM1B75.1 (SEQ ID NO: 317)

SEQ ID NO: 318 - protein, 749 aa, Artificial Sequence
  FM1B76.1 (SEQ ID NO: 318)
QVQLVESGGGVVQPGGSLRLSCAASISIFDIYAMDWYRQAPGKQRELVAVSFRDGSTYYADSVKGRFTISRDNSKNTLYLQMNSLRAEDTAVYYCHVSLYRDPLGVAGGIGVYWGQGTLVTVSSGGGGSGGGGSEVQLLESGGGLVQPGGSLRLSCAASGRTYAMGWFRQAPGKEREFVAAINALGTRTYYADSVKGRFTISRDNSKNTLYLQMNSLRAEDTAVYYCTAQGQWRAAPVAVAAEYEFWGQGTLVTVSSGGGGSGGGGSEVQLLESGGGLVQPGGSLRLSCAASGFTLENKAIGWFRQAPGKEREGVLCISKSGSWTYYADSVKGRFTISRDNSKNTVYLQMNSLRPEDTAVYYCATTTAGGGLCWDGTTFSRLASSWGQGTLVTVSSGGGGSGGGGSEVQLVESGGGLVQPGGSLRLSCAASGFTFSTSWMYWLRQAPGKGLEWVSVINTDGGTYYADSVKGRFTISRDNSKNTLYLQMNSLRAEDTAVYYCAKDWGGPEPTRGQGTLVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSRLTVDKSRWQQGNVFSCSVMHEALHNHYTQKSLSLSPGK

SEQ ID NO: 319 - protein, 227 aa, Artificial Sequence
  FM1B76.1 (SEQ ID NO: 319)
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 320 - protein, 484 aa, Artificial Sequence
  FM1B67.2 (SEQ ID NO: 320)
QVQLVESGGGVVQPGGSLRLSCAASISIFDIYAMDWYRQAPGKQRELVAVSFRDGSTYYADSVKGRFTISRDNSKNTLYLQMNSLRAEDTAVYYCHVSLYRDPLGVAGGIGVYWGQGTLVTVSSGGGGSGGGGSEVQLLESGGGLVQPGGSLRLSCAASGRTYAMGWFRQAPGKEREFVAAINALGTRTYYADSVKGRFTISRDNSKNTLYLQMNSLRAEDTAVYYCTAQGQWRAAPVAVAAEYEFWGQGTLVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 321 - protein, 482 aa, Artificial Sequence
  FM1B67.2 (SEQ ID NO: 321)
EVQLVESGGGLVQPGGSLRLSCAASGFTFSTSWMYWLRQAPGKGLEWVSVINTDGGTYYADSVKGRFTISRDNSKNTLYLQMNSLRAEDTAVYYCAKDWGGPEPTRGQGTLVTVSSGGGGSGGGGSEVQLLESGGGLVQPGGSLRLSCAASGFTLENKAIGWFRQAPGKEREGVLCISKSGSWTYYADSVKGRFTISRDNSKNTVYLQMNSLRPEDTAVYYCATTTAGGGLCWDGTTFSRLASSWGQGTLVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 322 - protein, 484 aa, Artificial Sequence; identical to SEQ ID NO: 320
  FM1B68.2 (SEQ ID NO: 322)

SEQ ID NO: 323 - protein, 482 aa, Artificial Sequence
  FM1B68.2 (SEQ ID NO: 323)
EVQLLESGGGLVQPGGSLRLSCAASGFTLENKAIGWFRQAPGKEREGVLCISKSGSWTYYADSVKGRFTISRDNSKNTVYLQMNSLRPEDTAVYYCATTTAGGGLCWDGTTFSRLASSWGQGTLVTVSSGGGGSGGGGSEVQLVESGGGLVQPGGSLRLSCAASGFTFSTSWMYWLRQAPGKGLEWVSVINTDGGTYYADSVKGRFTISRDNSKNTLYLQMNSLRAEDTAVYYCAKDWGGPEPTRGQGTLVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 324 - protein, 484 aa, Artificial Sequence; identical to SEQ ID NO: 320
  FM1B69.2 (SEQ ID NO: 324)

SEQ ID NO: 325 - protein, 480 aa, Artificial Sequence
  FM1B69.2 (SEQ ID NO: 325)
EVQLVESGGGLVQPGGSLRLSCAISGLSLDTYAVGWFRQAPGKEREGVSCISSGHGMTYYADSVKGRFTISTDNSKNTVYLQMNSLRAEDTAVYYCATESRYYCSDNWPAPQRYIYWGQGTLVTVSSGGGGSGGGGSEVQLVESGGGLVQPGGSLRLSCAASGFTFSTSWMYWLRQAPGKGLEWVSVINTDGGTYYADSVKGRFTISRDNSKNTLYLQMNSLRAEDTAVYYCAKDWGGPEPTRGQGTLVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 326 - protein, 483 aa, Artificial Sequence
  FM1B70.2 (SEQ ID NO: 326)
QVQLVESGGGVVQPGGSLRLSCAASISIFDIYAMDWYRQAPGKQRELVAVSFRDGSTYYADSVKGRFTISRDNSKNTLYLQMNSLRAEDTAVYYCHVSLYRDPLGVAGGIGVYWGQGTLVTVSSGGGGSGGGGSEVQLVESGGGLVQPGGSLRLSCAASGRTLSIYSMGWFRQAPGKEREFVATIGWNSGRTFYPDSVKGRFTISRDNSKNTLYLQMNSLRAEDTAVYYCAAAKGPLRLSSQADYWGQGTLVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 327 - protein, 482 aa, Artificial Sequence; identical to SEQ ID NO: 321
  FM1B70.2 (SEQ ID NO: 327)

SEQ ID NO: 328 - protein, 483 aa, Artificial Sequence; identical to SEQ ID NO: 326
  FM1B71.2 (SEQ ID NO: 328)

SEQ ID NO: 329 - protein, 482 aa, Artificial Sequence; identical to SEQ ID NO: 323
  FM1B71.2 (SEQ ID NO: 329)

SEQ ID NO: 330 - protein, 483 aa, Artificial Sequence; identical to SEQ ID NO: 326
  FM1B72.2 (SEQ ID NO: 330)

SEQ ID NO: 331 - protein, 480 aa, Artificial Sequence; identical to SEQ ID NO: 325
  FM1B72.2 (SEQ ID NO: 331)

SEQ ID NO: 332 - protein, 484 aa, Artificial Sequence
  FM1B73.2 (SEQ ID NO: 332)
EVQLLESGGGLVQPGGSLRLSCAASGRTYAMGWFRQAPGKEREFVAAINALGTRTYYADSVKGRFTISRDNSKNTLYLQMNSLRAEDTAVYYCTAQGQWRAAPVAVAAEYEFWGQGTLVTVSSGGGGSGGGGSQVQLVESGGGVVQPGGSLRLSCAASISIFDIYAMDWYRQAPGKQRELVAVSFRDGSTYYADSVKGRFTISRDNSKNTLYLQMNSLRAEDTAVYYCHVSLYRDPLGVAGGIGVYWGQGTLVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 333 - protein, 482 aa, Artificial Sequence; identical to SEQ ID NO: 321
  FM1B73.2 (SEQ ID NO: 333)

SEQ ID NO: 334 - protein, 485 aa, Artificial Sequence
  FM1B74.2 (SEQ ID NO: 334)
EVQLLESGGGLVQPGGSLRLSCAASGRTYAMGWFRQAPGKEREFVAAINALGTRTYYADSVKGRFTISRDNSKNTLYLQMNSLRAEDTAVYYCTAQGQWRAAPVAVAAEYEFWGQGTLVTVSSGGGGSGGGGSQVQLVESGGGVVQPGGSLRLSCAASISIFDIYAMDWYRQAPGKQRELVAVSFRDGSTYYADSVKGRFTISRDNSKNTLYLQMNSLRAEDTAVYYCHVSLYRDPLGVAGGIGVYWGQGTLVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGKK

SEQ ID NO: 335 - protein, 482 aa, Artificial Sequence; identical to SEQ ID NO: 323
  FM1B74.2 (SEQ ID NO: 335)

SEQ ID NO: 336 - protein, 484 aa, Artificial Sequence; identical to SEQ ID NO: 332
  FM1B75.2 (SEQ ID NO: 336)

SEQ ID NO: 337 - protein, 480 aa, Artificial Sequence; identical to SEQ ID NO: 325
  FM1B75.2 (SEQ 337)

SEQ ID NO: 338 - protein, 749 aa, Artificial Sequence
  FM1B76.2 (SEQ ID NO: 339)
QVQLVESGGGVVQPGGSLRLSCAASISIFDIYAMDWYRQAPGKQRELVAVSFRDGSTYYADSVKGRFTISRDNSKNTLYLQMNSLRAEDTAVYYCHVSLYRDPLGVAGGIGVYWGQGTLVTVSSGGGGSGGGGSEVQLLESGGGLVQPGGSLRLSCAASGRTYAMGWFRQAPGKEREFVAAINALGTRTYYADSVKGRFTISRDNSKNTLYLQMNSLRAEDTAVYYCTAQGQWRAAPVAVAAEYEFWGQGTLVTVSSGGGGSGGGGSEVQLLESGGGLVQPGGSLRLSCAASGFTLENKAIGWFRQAPGKEREGVLCISKSGSWTYYADSVKGRFTISRDNSKNTVYLQMNSLRPEDTAVYYCATTTAGGGLCWDGTTFSRLASSWGQGTLVTVSSGGGGSGGGGSEVQLVESGGGLVQPGGSLRLSCAASGFTFSTSWMYWLRQAPGKGLEWVSVINTDGGTYYADSVKGRFTISRDNSKNTLYLQMNSLRAEDTAVYYCAKDWGGPEPTRGQGTLVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 339 - protein, 227 aa, Artificial Sequence
  FM1B76.2 (SEQ ID NO: 339)
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 340 - protein, 122 aa, Artificial Sequence
  SD1046 humanized variant (SEQ ID NO: 340)
EVQLVESGGGLVQPGGSLRLSCAASGRTLSIYSMGWFRQAPGKEREFVATIGWNSGRTFYPDSVKGRFTISRDNAKNTLYLQMNSLRAEDTAVYYCAAAKGPLRLSSQADYWGQGTLVTVSS

SEQ ID NO: 341 - protein, 26 aa, Artificial Sequence
  FR1 sequence
EVQLVESGGGLVQPGGSLRLSCAATG

SEQ ID NO: 342 - protein, 26 aa, Artificial Sequence
  FR1 sequence
EVQLLESGGGLVQPGGSLRLSCAASG

SEQ ID NO: 343 - protein, 26 aa, Artificial Sequence
  FR1 sequence
EVQLVESGGGLVQPGGSLRLSCAVSI

SEQ ID NO: 344 - protein, 26 aa, Artificial Sequence
  FR1 sequence
QVQLVESGGGVVQPGGSLRLSCAASG

SEQ ID NO: 345 - protein, 26 aa, Artificial Sequence
  FR1 sequence
EVQLVESGGGLVQAGGSLKLSCAASG

SEQ ID NO: 346 - protein, 26 aa, Artificial Sequence
  FR1 sequence
EVQLLESGGGLVQPGGSLRLSCAASG

SEQ ID NO: 347 - protein, 26 aa, Artificial Sequence
  FR1 sequence
EVQLVESGGGLVQAGDSLRISCAASG

SEQ ID NO: 348 - protein, 26 aa, Artificial Sequence
  FR1 sequence
EVQLVESGGGLVQPGGSLRLSCAASG

SEQ ID NO: 349 - protein, 26 aa, Artificial Sequence
  FR1 sequence
EVQLVESGGGLVQPGGSLKLSCAASG

SEQ ID NO: 350 - protein, 26 aa, Artificial Sequence
  FR1 sequence
EVQLVESGGGLVQPGGSLRLSCAASG

SEQ ID NO: 351 - protein, 26 aa, Artificial Sequence
  FR1 sequence
EVQLVESGGGLVQPGGSLRLSCVISG

SEQ ID NO: 352 - protein, 26 aa, Artificial Sequence
  FR1 sequence
EVQLVESGGGLVQPGGSLRLSCAASG

SEQ ID NO: 353 - protein, 9 aa, Artificial Sequence
  CDR1 sequence
FTLENKAIG

SEQ ID NO: 354 - protein, 9 aa, Artificial Sequence
  CDR1 sequence
FTFSSYAMS

SEQ ID NO: 355 - protein, 9 aa, Artificial Sequence
  CDR1 sequence
SIFDIYAMD

SEQ ID NO: 356 - protein, 9 aa, Artificial Sequence
  CDR1 sequence
FTFSSYGMH

SEQ ID NO: 357 - protein, 6 aa, Artificial Sequence
  CDR1 sequence
RTYAMG

SEQ ID NO: 358 - protein, 9 aa, Artificial Sequence
  CDR1 sequence
FTFSSYAMS

SEQ ID NO: 359 - protein, 9 aa, Artificial Sequence
  CDR1 sequence
RTLSIYSMG

SEQ ID NO: 360 - protein, 9 aa, Artificial Sequence
  CDR1 sequence
FTFSSYAMS

SEQ ID NO: 361 - protein, 9 aa, Artificial Sequence
  CDR1 sequence
FTFSTSWMY

SEQ ID NO: 362 - protein, 9 aa, Artificial Sequence
  CDR1 sequence
FTVSSNYMS

SEQ ID NO: 363 - protein, 9 aa, Artificial Sequence
  CDR1 sequence
LSLDTYAVG

SEQ ID NO: 364 - protein, 9 aa, Artificial Sequence
  CDR1 sequence
FTFSSYAMS

SEQ ID NO: 365 - protein, 14 aa, Artificial Sequence
  FR2 sequence
WFRQTPGSEREGVL

SEQ ID NO: 366 - protein, 14 aa, Artificial Sequence
  FR2 sequence
WVRQAPGKGLEWVS

SEQ ID NO: 367 - protein, 14 aa, Artificial Sequence
  FR2 sequence
WYRQAPGKQRDLVA

SEQ ID NO: 368 - protein, 14 aa, Artificial Sequence
  FR2 sequence
WVRQAPGKGLEWVS

SEQ ID NO: 369 - protein, 14 aa, Artificial Sequence
  FR2 sequence
WFRQAPGKEREFVA

SEQ ID NO: 370 - protein, 14 aa, Artificial Sequence
  FR2 sequence
WVRQAPGKGLEWVS

SEQ ID NO: 371 - protein, 14 aa, Artificial Sequence
  FR2 sequence
WFRQAPGKEREFVA

SEQ ID NO: 372 - protein, 14 aa, Artificial Sequence
  FR2 sequence
WVRQAPGKGLEWVS

SEQ ID NO: 373 - protein, 14 aa, Artificial Sequence
  FR2 sequence
WLRQAPGKGLEWVS

SEQ ID NO: 374 - protein, 14 aa, Artificial Sequence
  FR2 sequence
WVRQAPGKGLEWVS

SEQ ID NO: 375 - protein, 14 aa, Artificial Sequence
  FR2 sequence
WFRQAPGKEREGIT

SEQ ID NO: 376 - protein, 14 aa, Artificial Sequence
  FR2 sequence
WVRQAPGKGLEWVS

SEQ ID NO: 377 - protein, 8 aa, Artificial Sequence
  CDR2 sequence
CISKSGSW

SEQ ID NO: 378 - protein, 8 aa, Artificial Sequence
  CDR2 sequence
AISGSGGS

SEQ ID NO: 379 - protein, 7 aa, Artificial Sequence
  CDR2 sequence
TSFRDGS

SEQ ID NO: 380 - protein, 8 aa, Artificial Sequence
  CDR2 sequence
VIYSGGSS

SEQ ID NO: 381 - protein, 8 aa, Artificial Sequence
  CDR2 sequence
HINALGTR

SEQ ID NO: 382 - protein, 8 aa, Artificial Sequence
  CDR2 sequence
AISGSGGS

SEQ ID NO: 383 - protein, 8 aa, Artificial Sequence
  CDR2 sequence
TIGWNSGR

SEQ ID NO: 384 - protein, 8 aa, Artificial Sequence
  CDR2 sequence
AISGSGGS

SEQ ID NO: 385 - protein, 7 aa, Artificial Sequence
  CDR2 sequence
VINTDGG

SEQ ID NO: 386 - protein, 7 aa, Artificial Sequence
  CDR2 sequence
VIYSGGS

SEQ ID NO: 387 - protein, 8 aa, Artificial Sequence
  CDR2 sequence
CISSGHGM

SEQ ID NO: 388 - protein, 8 aa, Artificial Sequence
  CDR2 sequence
AISGSGGS

SEQ ID NO: 389 - protein, 39 aa, Artificial Sequence
  FR3 sequence
TYYTDSMRGRFTISRDNAENTVYLQMDSLKPEDTAVYYC

SEQ ID NO: 390 - protein, 39 aa, Artificial Sequence
  FR3 sequence
TYYADSVKGRFTISRDNSKNTLYLQMNSLRAEDTAVYYC

SEQ ID NO: 391 - protein, 39 aa, Artificial Sequence
  FR3 sequence
TNYADSVKGRFTISRDNAKNTLYLQMNSLKPEDTAVYLC

SEQ ID NO: 392 - protein, 39 aa, Artificial Sequence; identical to SEQ ID NO: 390
  FR3 sequence

SEQ ID NO: 393 - protein, 39 aa, Artificial Sequence
  FR3 sequence
TYYSDSVKGRFTISRDNAKNTEYLEMNNLKPEDTAVYYC

SEQ ID NO: 394 - protein, 39 aa, Artificial Sequence; identical to SEQ ID NO: 390
  FR3 sequence

SEQ ID NO: 395 - protein, 39 aa, Artificial Sequence
  FR3 sequence
TFYPDSLKGRFTISRDNARNTLYLQMNNLRPEDTAVYYC

SEQ ID NO: 396 - protein, 39 aa, Artificial Sequence; identical to SEQ ID NO: 390
  FR3 sequence

SEQ ID NO: 397 - protein, 39 aa, Artificial Sequence
  FR3 sequence
TYYADSVKDRFTISRDNAKDTLYLQMSSLKSEDTAVYYC

SEQ ID NO: 398 - protein, 39 aa, Artificial Sequence; identical to SEQ ID NO: 390
  FR3 sequence

SEQ ID NO: 399 - protein, 39 aa, Artificial Sequence
  FR3 sequence
TYYADSVKGRFTVSTDNAKNTVYLQMNGLQPEDTARYYC

SEQ ID NO: 400 - protein, 39 aa, Artificial Sequence; identical to SEQ ID NO: 390
  FR3 sequence

SEQ ID NO: 401 - protein, 22 aa, Artificial Sequence
  CDR3 sequence
ATTTAGGGLCWDGTTFSRLASS

SEQ ID NO: 402 - protein, 18 aa, Artificial Sequence
  CDR3 sequence
HVSLYRDPLGVAGGMGVY

SEQ ID NO: 403 - protein, 19 aa, Artificial Sequence
  CDR3 sequence
TAQGQWRAAPVAVAAEYEF

SEQ ID NO: 404 - protein, 15 aa, Artificial Sequence
  CDR3 sequence
AAAKGPLRLSSQADY

SEQ ID NO: 405 - protein, 10 aa, Artificial Sequence
  CDR3 sequence
AKDWGGPEPT

SEQ ID NO: 406 - protein, 20 aa, Artificial Sequence
  CDR3 sequence
ATESRYYCSDNWPAPQRYIY

SEQ ID NO: 407 - protein, 11 aa, Artificial Sequence
  FR4 sequence
WGQGTQVTVSS

SEQ ID NO: 408 - protein, 11 aa, Artificial Sequence
  FR4 sequence
WGQGTLVTVSS

SEQ ID NO: 409 - protein, 11 aa, Artificial Sequence
  FR4 sequence
WGKGALVTVSS

SEQ ID NO: 410 - protein, 11 aa, Artificial Sequence
  FR4 sequence
WGQGTLVTVSS

SEQ ID NO: 411 - protein, 11 aa, Artificial Sequence
  FR4 sequence
WGQGTQVTVSS

SEQ ID NO: 412 - protein, 11 aa, Artificial Sequence
  FR4 sequence
WGQGTLVTVSS

SEQ ID NO: 413 - protein, 11 aa, Artificial Sequence
  FR4 sequence
WGQGTQVTVSS

SEQ ID NO: 414 - protein, 11 aa, Artificial Sequence
  FR4 sequence
WGQGTLVTVSS

SEQ ID NO: 415 - protein, 11 aa, Artificial Sequence
  FR4 sequence
RGQGTQVTVSS

SEQ ID NO: 416 - protein, 11 aa, Artificial Sequence
  FR4 sequence
WGQGTLVTVSS

SEQ ID NO: 417 - protein, 11 aa, Artificial Sequence
  FR4 sequence
WGQGTQVTVSS

SEQ ID NO: 418 - protein, 11 aa, Artificial Sequence
  FR4 sequence
WGQGTLVTVSS

The invention claimed is:

1. An isolated polypeptide comprising a single domain antibody and an Fc region, wherein the single domain antibody is capable of binding specifically to an HA of a first influenza strain and has an amino acid sequence selected from the group consisting of SEQ ID NOs: 17, 20, 24, 25, 155, 176, 197, and 203.

2. The isolated polypeptide of claim 1, wherein the single domain antibody binds to an epitope in the stem region of HA.

3. The isolated polypeptide of claim 1, wherein the single domain antibody binds to an epitope in the head region of influenza B HA.

4. The isolated polypeptide of claim 1, wherein the single domain antibody has the amino acid sequence of SEQ ID NO: 155, 176, 197, or 203.

5. The isolated polypeptide according to claim 1, wherein the Fc region is a human IgG Fc region.

6. The isolated polypeptide according to claim 1, further comprising a region that that is capable of binding to an HA of a second influenza strain.

7. The isolated polypeptide of claim 6, wherein the first influenza strain is an influenza A strain and the second influenza strain is an influenza B strain.

8. An isolated antibody comprising the polypeptide of claim 1.

9. An isolated antibody comprising the polypeptide of claim 7.

10. An isolated nucleic acid encoding the polypeptide of claim 1.

11. An isolated nucleic acid encoding the polypeptide of claim 7.

12. A vector comprising the isolated nucleic acid of claim 10.

13. A vector comprising the isolated nucleic acid of claim 11.

14. A pharmaceutical composition comprising the isolated polypeptide of claim 1.

15. A pharmaceutical composition comprising the isolated polypeptide of claim 7.

16. A pharmaceutical composition comprising the isolated nucleic acid of claim 10.

17. A pharmaceutical composition comprising the isolated nucleic acid of claim 11.

* * * * *